United States Patent 10,113,201 (METHODS AND COMPOSITIONS FOR DIAGNOSIS OF GLIOBLASTOMA OR A SUBTYPE THEREOF) - sequence listing, part 2

SEQ ID NO: 23 - DNA, 1369325 bp, Homo sapiens
gagacaccttcccaaacagcaggggttgtgtgctttcacatagcagtactgtacaaggaaaaccccgtcggatctgttattgcgggatacttgtgaaatatacataggattctttcttatggctgcatcccggatctggaaattttacttggggaccaggaggatttgaaaggctgcatgtactcagaagatttgcaagcaacactccaattcttgtcatagagctcgcagacttctcacttatcggcttttttccttccttattttttaagaattattcttattttcccctctctttttctgctctctcctctctcagtctctccttttctatctgcctcttcatttttctcctagtctgtttttttttttcctgctctgcacctggattgtatcttcagcaaacaatcgggcactttgagaactaactggagacagtcttgtagggaagatctgtatggaattatctgcttttatggtgaacttggcatttgtgaatgggaatcttgttcacaatattaattgctagcaaaaacaagaaaaagaacacaggagtaaaacgtggatttttctgaatacgcattgtgatgaccagcaattaccttaccgactaatatccagaggagaataatttggaagactgttgtgggtaaggtcattttatatatgcaaacccatcagtggcatgagcaaacttgggcatttgtaatgggaatgggtgacttgaatgattgctgcatcgcattgatggctgtgatgtggccgttattggcactgaatggaataactgcagttgggtgtgttgatatgtgtgtgtgtgtgtgtgtgtgtgtgtgtgtgtgtgtgtgtatgtgtgtgtgcgtgtgtgtgtatatgtatgtgtgcccgtattctgagtgcaattgaaaatcaaagtatcactctctcccccaattattttgatatggaagagtgtcttgaattaattctgggtagacactctttgtttgaatgtaatatttgtggcccctgcgttctggaaggggtagcagcagtaaaagaaacacttagtgaagagccccatttaaaatgaaacgagctactctctatgcattaaaagaaatatgttttcaactcagtgcagcattctgctgcatttcacagccgcaatgggaccagggacatcccacttgtcaagttcttaaactttaaggtgataatcatcgttaattgttctctaggttgtggttactggagattattaagcgccctgggctacttttttatctactggattatcactcagagtgaaaaaaggaaaagaaaagaaaaagctaaaaatgatggctaacatagagaagaataaggcaacattatcttaaatatcaccacagtgctttctttctcaagttcaattgcccaataatataattatttacccaatatcctaaatagctgaagctgagacccacgtgcaggggagtcgaaggtctgaaagcagagaccgtccttttattgcaatgcagccagcttgggaaatgcaggcaattaattacatacttcccctaaccttaagttgaagatgtgtcctgtctgctacatctattttaccctttcggtaaaaagttagagactagaacactaaggatgtttaagcatattctgcctgggaaatgggataaagaaatcaatattgatgacgtggttcagtgcactgtactgcaatgctaaagttccatattcagtgcctgtgatgagagagtggagcatttacatatgttataaatctcacctggtagattgatccaaaggggaggggagaagatatgtggatatgtaggaagatggatggaagtcgtgcataatcggtgattatgtaacttcattacatcagcgagtttcagtcaacgatagtgagatgagatgattgtatagagagaggctccatcaccctgttaacttttgaaggcttgtaacagctaacagaggaggagggcagagagagattagctccaagggtcctgtaaaccttgatctctatggcaaattttgcatgagttttctcatagtgagtttcggagggacatcagatcatataagctttagggctggacaggaccaattttagccacacccgtggagagtcaaaatgagtctgcgatgtttcagaagtgccccattgagtaactgggactgatgattccagccaaggtcatagttctttaccctaggattgaaatatatgaccccaactgaatggaaagttaaattcattgaaatgatgactgtgaacggaatgaatatttagggtcctttcttgcatttttcctggtagagcttgatgcagatttcagcctggtggttccctcataaaaatgatgattgcttccacagcgtgtcagaaatgactgttttgtccctttatcttaaccatgacaatctctttctgggccattttaaccttctgggaaaagagaagtaaaagcattcaaaggtaacagtaccctgttaaattacaaattaaatggcactggattcattattaacacaaatcccagaaaaaaagagcaatccatgttcaagtttcacttattgaatggcttaaaagacaggttgcagctgccaaagacttttaccatcatatgagataaatgtactgtgctcactgtgcagagaagggaatactgcagaataaaatgtcattttccctcatgttttatctggagttgtgattttttttaaagaagatacacatcaggtccttttggccttctactgttttaggatctgttttctcctcaatagatcacatattcacaaaaaatgaaacttctgaaatcctaaccctgttcagttgaatcaccttattatctagttgtgctatttcctatttctctttacatttattttacaaagagggctaaacgacttttctgtcagggagatgagatgatttttttctgtttttcttttatttctcatattccatttccttccagtcctaaggagtaagatgcagaatctagacaccctctaagtaactttgaaaagatttgctcaccctgagtcagaatggtgggattggggaatgaaattctaaggtctgatatttgaggtgactttcatacttctgcaggacatgcacaaacattgatgtattgtgccagtggattgggaggtttggcgttcatattgtgtaggaaattgaatgtgaatttaactcctgattccttccttcaggggtcagggtagcacaacagctgcttccaggctgttggtttccaactatgtgcacaaatatagtctgtaatgatttttcctactccttctttcaatattttataaatgacttcctcagttgttttctgacgtaagccacacatatgttaccaagcagggcataggttttctaagctcagtaggagatggaaataatagcaggatggaaaaagattctgtacaaaaagacactggttgtgaagcaaatatacatatgtaattgctaactccttacttgaagactgcatatacttctattaggaaagatagtttcaatcatgttaatggcactttataagctgttactttctttaggaagattatgtaactaaggcaggttatggcatttttcttaagtatcctacacattagtaataaaaagctttgtctaataggaaagcatttaaacatgatggcagtgggtaatttgaaatgtaacatctattttctattttatttccattttgtcagccgcagtcatgtagttaggttagaaaatatttgggaaaaaaagaaataccatttatgaatatgaaagctatcaattttgcttcctgaccagttgcttcagcaaagtaaggagatttagcagataagtaatcacggtattcctaaaactagagaaaattttaaattgaattttcattatgtttgcaacatatgtgaacaaatcagtattacttttaaaatggctattagataaaacattttaaagaacagttgaactttgaagatttatatttcagaatttgttagtttgttacacactgaaatgtttgggatgtactttgacttacaacagatatgatgtttggtgtttggcaaatcttgtgtttttataaagcagactactctataatttgtagcaacaaaacaagtgttgattattgagatttaaaagtagcaagttttctggtgatgctcaagttataaagcataattataattgtaccggttgggcagctataggtaaggtcgcgtcagcctttttattactaaattccaaccctatttccattaggtttatcgggaatctcaaagaggagagtccagttctgtgagacatcaaggcattgtagaattccgggctgagtcagagggctcgaaactgtacttccggctctgtcaattactagccttgtgacctctgacaccacatttgatttctcagtgttccagagaatcattttttaaaaaaataaatagttgcacattgctctacagaaaggagataatatgtgtctaagtacttaccaccatcctatgccttagaaatatatggaattattattaaggattcccttaagtcttattaatttagctgtgcatgttttttacacccttattgtaaatctgaataggtgctttctagtagcaattacagttagctgtacataatactgttcagtgattaaccaacaaagacaaattaaaagctttgttggttaactttcactcagtactcagttttttccagaagtactcatatgggaatatagttgtcttaagtaattaaaaaaatagttgcttttgaataacattcaaacagtggtaactaagggttttatgtgtgagagtgttttctgcagattgctttttaaaaaatgcttctgagtacttaggagtttctgtttctgctaccaagagcacacaaacaaatgtacacaaacttgatgctacttcacagactgagtacattgaccagaaagtgactcttgtctttcagtatattaacaaaagcataatgagtttgaataccaagtgtaatagagaaaatgagaatataaagatacccggtctgtttggaattttctagttgtaataattactaactttctttagggggaggcaatcccccatgtgtcactactaaaactgcatctctttaatgttcttgtatcttaacagaatgatatttacatatatgcaaagaggatagtttagtgatatgagcttccatgtatgtttttcagtgactgaataatcaggttacagagtaagtttttgtattttggttaaaatagaattggaaagtgcaaaattaaccctgtaataaattagtagtcctgggcttaaaataaagaattttcatgttgtagagcaacctcctcttcgtaacttcccagtgtcttgcttttcttttcaaggattcccaatatatttttgtttcagatgaatttcattatgcatgtttatctgacttcattgatgcctattaatagcaagcattttcttggtttcctatatttaaaaaatgcatgttctttatgtcttatggcaatactttagatttgctctggcagatttatgaaagaatattgtatgaatgtagacaggcttgtttatttgacaaattcagctaatcaccttacaaatatgcttttaattttcacccagaaaatgccaccctggagtgtcttatactgcatataacattctattacagtccaaccacatggctcagtggacatacttatccattaagtatgcttatcctgaccattggtttactaggaaagatccttaattgacatgctttttggtatccttgtgtagacacaatattcaggtgcccaaactctaaaactcctgtcttttagctacagagaagggatgactaggtggcttgatgttgctttcttatcacatgatctgaaaatcccaggcactgaactgtgaataaagcaaagggagaaagaaaagaaagagaactaaaagaaaattttacttctgaaaattttgctctttcccattttaatatcacaatattaaaagcaatcttttttatcacaagctattcaaatggtttgttatagttactatgctcatatatatcaaatacgataaatggcactaaatgagctgctttgttcttacaggagctacacctctgtgaacataaatttaagagttaaactagattgtacgttgtaacactacgtcaggatattgtgtgtagaatttggacttactgaaaaattgaaatggattgtggattgtaatcatataattatagacttttactctttcgatgtttattaggtatcttatactttatttgaattataattataataaatcagcatatggataatcataaaattattcatagtagtttatcttcttatgacctaatcaaaacgagttaccttatcgatgttttagattaatatgtatgacttggtatagtgatcttcatcattttctggtgcaaagttccctttttaattaaaaaaattcactggaagtccacttagtcatagttatactttcagtatccattaattgagaaaatgcatgataataatagtaaattattatgaatataataactctttaaaaatgaatttatgtatagtcacaacagagtctacttatatctttgaaatgcatggtttattctatctacatagaaagtttggtgtttatatagattctagattccttggagtaactcctgcagctgtagtaaataaaagatccatatgtctagaggcaaaatacttgcattacatatacatattaatcatgttcatcttacagagaaaatgaaaggtaagtgcgtatggtggtggtttgtggatcaaaggagttgaatttcggtatagatggacttaagagtatataattttctgaggatgtacatttagagttccaaaatattcccattcgagttttaggattcaacagttgtaatttaaaattggttgattttggaaaataattgcttttttaaaaaataaacattgtttttattgtagccaaaataaaaatgaattattataaaagccaaaggtgatcaaaatctcataaaaacctaatagaattatatgcattataggagtaagggatgccccattatgtgattttaaacaaggaatttgcaaaccagagaaatgaagtgaagtttccaagatcttacaatttgttggctctctcatgatgcatgatttcagttccttcatataagccctcagctgggtgttctagttatatagcaatatgtcctggcatacagcattattttttattagtacagctaatgttggcatatcgaatcctttggcctctagcttactttaccgatttgtgatcagtcgtctgacttctgcactcagaatctgtggactttatttttcctttacgcacacctgatttttgacctcatttgatccctggagacacaatacaaaggagagttgagaacataggtcactggtgggtcttcttgtcttttccatactgtgcttttcccattagctttgtatctttccacctgcagggaattgctcttctttggagcctctccactttctggactttcctgaacatccctggccatctttgtctcagtgctgcatgctaccttcttgcttccaggggattccactaaggggtcctatcaaaatatcttctagctacactttatcccactttgacgatattgaatttcatatttcatttcttcatcaacagggtcagtctgcttacataaacaatagtgaaccaattttggaataatgaagacagtaatattttatcaagtttgccaagctacaatcatataactactactaaatgaacaagatacagctggtgtgtgtgtgtgtatcctcatatcctaatgactgcattaatatgtgtatccacacacatacatgatttttgttgaaatgtttgacaaatgaatcatcgttaatatgctaaagaggaaagtttggaataacaggctttatccctttgtattataatagtgacatttctagaaaagatgccattaacttctgaccccgaaaaatagcttgaaaggactgcattttagatgataaggtggagacagggctgtggaggacatacttttgttcaggctgaatcccgcagtgccctctagagttactgggtagggagctggtagcatacctgtatgaagaaatgacactggctatgaacactatgatgcttacaacctctctgccaactttatttcagaagagacacagtcaggagagctaaatacagtggtaaaaatggaaaaactgagagagttagaatggtatcaagtattttgtgtaaacaaagcttcatgtggccaagggagaaaatttgaatgtaacaaatggatctggtagctctcagtgtttggtttttggatacccctattaaagctcctaattgttctcaccatgacagaactcctgaatggtactcaagaggcacccagctccacagtgtgcagagtaaatgcattcaagggatctctaggggtttttgactctgctgttttttcttgtcgaggttctcctacagggcccttaataacacagccacagagcaagccgcttatgtcagtgggtgtgctcttctcaatgagtgaatggtttagcttagctctaggaggcaagtgcctgctggtcttgtatttccagggcccaacattgtgcacagcatatagtaggtcatcagtaaatcattacacaagcaaacgcttaaacacttacggataacaggtcagttttagatctgtgttctccaaaactcatgctacattatacgtagagacaaaagcttctgatttaaaaaagtaaaaaaaggaaaattgagtaataaaggagagagaattaatattaggtagtttaaaacctacaaatgaactgaaggagaagaaatcacctgcctgcctgtctccctccctcccttccttccttccctccctccccttcttcttcctttcctcccccttccttccacctctatcataggtatttaagtgccttcactgttcaaggggatgcaagagggactgcaaaggtccctccctacagagatgactgatgtcatgtgtctgggcccaaaaatggtttagttagggatatgactactaaacaaaatcacatataccgacatcccttggtgtccatggggattggttccaggaccccttgtggacaccaaaatccacagatgctcgagtccctaatataaaatggtctcgtatttgcatatgacctatgtacatcctcctgtataaattatctgaagattacttatacctaatacagtgtaaatgctatgtaaatagttgttacattgtatttttatttgtattatttttaattattttgttgttctttttaaattgtttttaaaaaatattcctgatccatggttgcttggatccacagatatggaaggccacctgttattataattcaagatagtctaccatacatacttctaagagagatgccaagtatgctatgggctcaagaaacgttcaggacacatgcacgtagagggattaggtgaggcttgctgaaggaggcagcctttgtattggactttgaaggagttaacatgggtatggagatgtgaccttctaaatagaggggagatcaaaaatatactgtaaggaggaccaaatggagcatggttaaggaagatccaatgttcttgtttccccagagaagggggtatatgatatgaaatgtaagaagataaggctggagccctgagccttcatgtctggcaagcaggagccaatggaatggtattgcatgagcttaaggaaaacagaacatttcatgacccgctcagatttatgctttaggaagaagggggatgaattaagagtgtgtatctccaggttaccattgatttcaagttgtgtgaatttcccagtgactcctgagtttcacgcttattccaattttctcatgtagaaccccaggcctcaaacaggcatcactggctctcttcattttcctctttctttcttcctttcaaagaagaaactgctgggtgcagtggcttcacgcctgtaatcccagcactttgggaggcggaggcaggcggatcaccggaggtcaggagttcgagaccagcctgaccagcatggtgaaaccccgtctctactaaaaatacaaaattagccgggcatggtggcacatgtctgtaatcccagctacttaggaggctgaggcaggagaattgcttgaacctgggaggcagaggctgcaatgagccgagatcacaccattgcacttaagcctgggcaacaagagtgaaactctgttcaaataaataaataaataagcaaacaaaccactgctaccagtgctggataaatacagaagccagagtttaacattagcttttacttttttcaagcagaaggcaagattctgtaatggggctgatccattcaaactatccttgcttggtagtattagaaagttgccacacactgtagcaacaatgctaagatttaagtaactctttaatgagtacactggataatgtttaaagtttatttctttactgtgatggcaacagcaaagtgactctaaagtgacaattcatctggaagaaagaagttgaaggaagcaactgggaaaaaagaaaaaaggaaagtgctttatataatgtaatgccaaggtggaaatatagatttcaaaatggttttatagtaagatcatatggaataagaatattgctttcgagtagaatgtacattcagtaataagataataggatttatttctaacaagtgtgaactcttttgctaactaccaataattataacaattttgaattgtagctggaaattggaaagtgagcctcctagtaataaaaaatccccatgctagtttagtttaaattatttttcttatcaaatactttatctacacttctaataagtggaagaaaagaaaccagtaggtatagttttttttcccatactgtatctgatcattctatattggaagatgtagtaagctggaaaatagccaaacgttgaagacaaaatgagaaaaaatgcaatttacttaggcacaaactaaatgttatgtacatcatccttaggattcaggtgaaagaacaagtctcacagtctagctgttgtcaaaactcactcccctatccctgaggatcctgattcggtgtttggaatgcagtatagaaatttgtaggtttttttttttttttttgagatggagtttcgctcttttttgcccaggctggagtgcaatggtgcaatcttggctcactgcaacctctgcctcccgggttcaagcaaatctcctccctcagcctcccgagtagctgggattacaggtgtgcgccaccacacccggctaattttgtatttttagtagagacggggtttcaccatgtcggccaggctggtctcaaactcctgacttcaggagatccacccaccttggcctcccaaagtgctgggattacaggcatgagccaccgcacccagccgagaaatttgtactttcaaaaacatttgagggccaggcatggtggctcatgcctgtaaccccagcactttgggaggccgaggcaagggaaacagcctgagttcagcagttcaagaccagcctggccaacatggagaaatcccgtctctactaaaaatacaaaaattagctgggcacattggcaggttcttgtgatcccagccggctactcgggaggctgaggcaggagaatcgcttgaacctgggaggtggaggttgcagtgagccgagattgcaccatgcaccattgcactccagcctgggtgacagagcgagactccatctcaaaaaaaaaaaaaaaaaattgaggtcagtaggatcaccaagatgttccttgggagggcttcagcagaaacctctcagtctctgtcagtattactttcctcctggcgtcataagttacaatggatattggatgctttcttgatgttttccaaagtgcccctccaactcagcttcaactttcaagtaataagtcatttccaaccacaatggcacagggtaggcccctactatgctgaaatcctcacactgccactgtctcagttgattatcatgcagcaattgtggctcattgtgggtccctactaaccactgtccttcagtcctattacgtgatcagaattgccccttcccatatgtattttaatgaactccttcatgtgagtgaatgagaaatactacttgagggccctatctgttgtaagaatggtgcttaacacaggctgtagatgctcaagacagttcttgccatctaaagcttatggaccagtgggaaaggcatatgtgttcaattgggctccctggaaacagactccgagatgaagaattgcatacaaaagttttagttgtttctgaggcagagaaactgactgcaatgtggttgcagctggggccccagcagttccaatgagaagttctaaagatttgatggtccttcaaaattgtctcacattgagtcaagggggttggggctttctgttttcacgtcaggcagtgactggcggggggctgccccacaggaaggagcataatgttgggaagacagttacttgcagctgagggtaaatcccgatgagggactcggctgtgagccaccaacggcaggatgggtatacaggccattaagaggggaatgaaagttatttggagtctctgacaagatcgtattttttctctcaccccttgaggcatgatgcaataataccatatgaaattactgaggaaatgctgtgaaatcgtaaacatttgtttaaagagataaagaaactaaatacaatggagtataaggccttgctctatgtagttttgcttcagagaatgtgattttctcaggaatgtagttcaagtcacattatagttactctgttgtaagttaccaggccacaaatatctaatgagcacgttctatgtgtcctggacttccagagagagagaggaaaaagtggaaaattcatgcctggagaatttacataggacctttttttttttcctcggtggttcatgtgcctgattttgagtttaaggaggggatttgggggtgggggtcaaggaaggggcaaggaaatggaacagagtagagtggggccaagttttctgaattccaaggataataagacaattgtttgggttgtacaggaccaggctacagaggaatattgaaagttggcggaaggcacagacttgatgaactgagtggtagtggaataagtcgaatgtagatttactggtacagaacagacagtgaaagcagtgtttcattagcattagccagtctatgatttggactggaggggaactagttttgaatacgatgaatttgaaatcatcgaaataatatatcctagagttcaattttcactgaaaggaagcatttcatataacactattcacttttatattatgtggaaatattaatttccttccttaatgcaagggaagtgacattacttagatttttaaaatgctttcttcaaccctagtgaggtaataggagcaccttctatttttatcctataaagattttcaatcaagttaaatacactgacacttaattttgccagtaagtttttaaagtactggctgtgtctaaatgggcaaccattcattaaatcatagaaaaattgaatagggatgaactaagtacatacctttacagatataaacatctctcggccaggcacggtggctcatgcctgtaatcccagcactttgggaggctgaggtgggcggatcatgaggtaaagagatcgagaccatcctggccaacatggtgaaaccctgtctttactaaaaaaatacaataattagctgggcgtggtggcgcgtgcctgtagtaccagctactctaactagaggctgaggcaggagaattgcttgaacctgggaggcagaggttgcagtgagctgagatcatgccactgcactctagcctgagtgacagagcaagactccatctcaaaacaaaacaaaacaaaacatacaagcaaacaaaaaatctctcaactaccaaaaaattatccattaactgatattcactttaataaataaccactttggcaattttttccctcacttgacctaacattgactagatggtcaactcaattcagttcaacaaatacttccagatgatccacctactccatgcttaattcaagcacaaagctagaatgaggaatttactcattgccacagcaactgaggatgcacattgttaagcattttaaaagatctgtcttaaaaaaaaatagtaatctttgctaccagcacctagcttgctttaaaagcatttgttagattccttctctggctttggcttggtttttttggaataataataataaaaaaaaaagttggccaggtatggtggttcatgcctggaatcccagcactttgggaggccaaggtgagtggatcacctaaggtcagaagttcgagatcagcctggtcaacatggtgaaaccccgtctctactaaaaatataaaaattagccagacgtggtggcgcacgcctgtaatcccagctacttgggaggctgaggcaggagaatcgcttgaacctgggaggcggaggttacagtgagccgaaattgcaccactgcactccagcctgggcaacagaacgagactccatctcaaaaaaaaaaaaaaaaaagaaaggttcatggtatttttaaaagaccaagaattcaatcaaggtgacactccttttccatcacaatactctacttgtgtgtatggacctatatattttattgtttcaaatacaaattgtgaagcttattaaggagagtccaacatttctatatattcactagctgttttttcattaaatataacttcaaggctccaggctcaaaaattgttccatttttactgattgcatcatgctatttgtgcacagcacacttttatttttgtccgcatagatttgaagcaatggtttttttactctgccacacaatgccacatccctgacagtaggtaagttatgttcttttgcattttttactcaagagctatgtaggtggtatgggagatgagtggcggctattggaacagactgtgcatcagacgctatttaaacctcatctatatgtgcaagttaagagttactatttcctgtttccaaagtgaaaattagttttaatttcttaaatttgtaatcagagaagatgtgggttattgttctaagcatcttctttggactcttccaatgttttggtagcaaagattcaaatattagtaagtctaaattcatcttttattaatttgggtactcctgctagcccaatcttattatttttaatattagtgttaatgttactattggctatgattacaaaagtataaaaataatatatttaataaagcctcatcatgtggcttcagtctagttttgggaacctgaaagatattatgaaaattaaaggtttagtattgcttcattgaatcattacttaagtcaaagatgttaagcagacttagttattatgattaaatcctttccactccaagaattacagtaccagaaatgtgcaatttgtatacacacaaatttactttttgagactattgaaaggtaattggaaataatttcatacctgaggacagtctcttagaaaacatatttgtgtgagtccttgtttatttggatcatactggagttgtaggcaacatatttgtgtgactaatatcatcaccattgtctccatcataatcattatcaacaagctggtattaattttaaaagtgttcattatacaatcaaaaaagaactatataggacaggaccctgactattgaatataatgagcttgaaccaaggattatgtggcttgcggaaatactgtgaggtaaatgaattttgcctgtgacatacttctgtgttcagtttcagcaactcccacttcgtttgaatcccaaatgctcacgtgaataactttagtttctgaatgctaagagtattctgtcacagagaagactgttttcttaaaaatatatgctcccaagctaccactagctatgtatttttctcatcaaatttattatttttaaatgtatttctttgtgtcttcctaactttagtataaggctgagaggatatgacctcatttatctggttcaccacatatctttggtgcccaggagagtgcctgtcacattgtgcaatttagttcaataattatcaaaggaaggaaagaaaggaagaagaaagggagaaagaaagaaaagaaagaagaatctcccgaggtgtcctggtctaagcaagataataggagaaaagagagtttgatttaaaaacacactaagcctagcttggtagatatatgacatttgcattgtaaaggtgttgttcatgatgcaatgttactggtatagtaaagttagcgtttattccatccctcatggggatgggtacaggtatatcacatgctctaaattgccaggtctgttgacagaatgccagaatgccaagctgatagcttagaacctatagccaaagattttggttgcatcaataatgcagaaagcgatgtcttaaggaccattattctgacagtatgtttttaaggtgagcaatgccaagatagactgaagcctacagttagatggcactatatattttataaattacaaggtgataaaagttctcattgttttagcttcttagcttttttccctacttttccctatatataagtatccattaagaagaagctttaaaaaaacactaatttcatttttatctctttcatagtatcaatataccttctcccaattgcagaagacatcatgttatactagaattcacatttggatcaaggcaagtgtgagttccaattttggctttgacatttactagctgtgtaaccttggataggttacttatgtttcagagtttcagtttccagatctctggagagaaaagaatacctacctttaggattactggaaaaagtaaaaattgtatttgtaggccaggtgtggtggctcatacctgtaatcccagcactttgggaggccgaggcgggtggatcacgaggtcaagagatcgagaccatcctggccaacatggtgaaaccctgtctctgctaaaaatacaaaaatgtgctgggtgtggtggcacgcacctgtagtcccagctacttgggaggctgaggcaggagaatcacttgaacccgggaggcggaggttgcagtgagccgagattgcaccattgcactccaggttggcgacagagcgagactcaaaaaaaaaaaaaaaaaaaaaggtatttgttaagcatatcgtgcagtgcttgacaaatcatagctacataataaatgctaatccttattttaatattttaacatgttatattaaaatataacaggaatattctttagttttctccctgtacccaatggtcaatattccatctttatcatacttgacctgtgggtaacaattgcacaatggatcagtccttgtccttgtttatttggatcatacttgacttgtgggcaacacttacacaatggatcactcctcctcagtacattttctttacctggctttggggacagcacaatctcttggtttaacttttttgctccttttaattctttgctgggaaaatgctccatggtttaactcttggctgtcttctcagtctacactcaccccttagtgatttcattcactcactctcatggctatcagtatcctttttgtcaccacctcttaaatttatatctaccttggtaacttttctgatttccaaacacatatatctaaccacttatttgacatcatcagctatttgacatttgtcacttactttgtccaaaactaaacttcttttttccctcccaaatctactttgttcgcaattttcccatctcgattgatgtcagtttcatccttgtatttgttcagacccaaaaccttgaaatcactcatcatttctctccctctctcacaaaccacatccagtcatcaagccttgttggtactatctttacccagatctagaatttaaccacttctcatcacctctactgctattatcctgtggaaccctccatcatctcttttctaaattactgcaaaccgccaaactgactctatgcctctgttattgttttctacagtctgctctcaatatagcagctacggttgccttttgaaaatggacaggttgtgtcactctacttttcaaatccctgcaaaggttgctgattttacttggagtaaaagtaaagttcttataatggcctaaggaaattcgcctacattacttccttgatttcatttccccgactcattctctcttttctagctctctcatttctcaccactctcaacttgctgttctttgaaggtgacaggtaagttcttgccataggaccttttcactggctgttctctttgtttggagcattatttacccagaagtctcaaggctaacttcctcacttccatcatttttggcttacctgtcatcttctccatgagacctaccccgaccacaccctctaaaatttcaatacactcacctccacactcctgatctccttatctggttctactttctaattcttttaggtacttcttaccatgtaacttttttataagttatttattattcttattgattattgctagagtttaagctccacaagagcaaagatctttgtccttttagttcactgaagtatcccaagcactgagaatgctatatgtaaatttggtaaaataaatattgttgtaaaataaagataattttcttacctagtgttactattgtgaaggtttaaataagataatgcagttagagcattttttcacagggcctgacataaattaagggcttaataaatggtcgccattatgaagtgtctcatggcgtaaacacacatggtatacaccaaaaatcaaaagtattacagcatgaaccctttttctcacattgaagttttaccaataccacaggcatataatatcttctctaggtatacacaagcatatcttattgtttcatgctcatctagtaaagataaagatatgctagcattcagcagtagctgacagttcacatatgtcagtgaaataaattgacactgttcttttttactttataccaattaaacttcatataatttaaaaagttggtgacaaatattctctaataaggataattttaaaaatatcactataagatgatattctctaataaggataatttttaaaatatcacaataagatgatttataagattcctgagagctccctaagaattaaagagctaacaaaaaaatgatattcccattatgcattttaatgaacaaccaattttcttctttttgtagatttcaatgacaacttggagagttcaacatgtttaacatttttgattcttttccatgttttataaatagaaaaaaataaaaatgattgtaatgaggtattcttatgtgcatcacaaatgtaggttttagtgtgcgggattcaatagaaaataaatactttctttttccatcttcatttgtgaaaatactgaaaaatagttataacggaaagtcttttgtaaatcaaaacaaaaagtattatttctgaatactgaatagatgttctcatcttgtctattgcctgatcatctagttgcttagtctaatcaaatacatttattcttctatgtttcattcgcatagcttagtcttttccagagaatttacgaatgttttactgcatgccaaaccttgggtaattaaagtcgacgacagaatgtgcccatagtttattctgtagatctgactgtagatgcagaggcttacattacatttggggtgaatgataagcttatattattttcttcttctactaaaaatattttaaagatatagattctagaattcactaaacaggtaatttgtgaataaatatattgccattttttaaaattgctcttttgttctctcatatgttcatcatgcagcttaatttcctttctccatgtttgggatggtcaggtagtcaccacttcccactaaagttcgttaatttttcaaccaccagaaaaaaaggtgaggaatgaaagaaggagaggaaaagagaagaatggcaaactccacgtaattgcctgaatgctaccttagatctaaatgttgtaagttttcctctaacattttagaaagaatcactttttttcaagcatttttattgccactcgtgcctactttactttgttactcctctgctgcttgtgggtggatggaatttgactatttcagaatagttactggtgggtgggttcaagaatctctagtgggttgaggaaaaagccatgtttatatagatagtgatccttctattaaaatcctaagagtgagtaatatttaatagctatgttcaccacgcacatagcagagtccatctgtacagaaactgagggtatctgaaaagaattccacgggagttttggcttcctatagagtttgcacgcagaggctctaatctcccaaattaaattttgtgacttgatggatagacaaggtttctttcctgagggcatgacatggacctggatgcctactggtctatacaagtgtaagatgctatgaacctgtcaagacttagctttcccactatagtggatcataacacacagctttagtgccttgtgtacattgctttgactacagatgtaaaacgtttaggttgactggctttaaattgtgggtagctgtggtaagggtaatcacatgatctacttagatgccaagtgagtgaattctcttctttgatttgaaatccagttcttttatatatatatttgagtacagagctggtagcagccagtgatgcaatgtacacattgaaagtgccataaatttagagatactttctgtatggccagaccacgggaaatgacaggcctttcaaactatagactattttagatgattgttcttgaaagaccacttcacttaatgtgatatttggattacaataaattctaaatcattgtgttctcatttctttcttttctatactgaagaaaatgccttaccttaatctttaccacttaccttaatcttcagagattgagtagtcattgatgttcattacccactttattgcagcaatgctactatcaaagcatgagatttgggtagctgcaacatgtgtacagctgaattctaagttttgcaggcagaacaccagtggtcaaattacatatattgtgtcataattattaaaaaatgtaacatatgaggacaattaaaggtctaaataatttgagatagacagcccattttaaaataacattttactttcattttattggcaagttttaagaccaaaatttaaaaggaccaaaaatggacataatttagatgtgcattttaatgaagaaagagaaaatgctaaatgatttggaaaaaaaagatatttagcatgatgcaacttctataaatgttttttttctcctgttctttaaagaatgaaataaagttacatgtaatggacggtattaaattcagactggcattaagatgtgaatgttttaaataagtgacatattttaatttgaaaatttgaatctaatataaaatgcaaattgcaatagcccttaatgtagaaaaagggaaaaatgtagtgattgagtttgggggaattgtaacttgggcagctctagccagctgcaatgatgaacaaggcttcctttattattgcttcaagaaaagctattgagtgtctagcacaaagtagctgcttgaatacgggaatatccaatatccctttgagaggcgtatttgattatacattttccctttaccctcttgtttctttctaactctccaagttccacaaaaagccccaagatcactgttgttattatcattggtgttgttttttgacccagaggttataccactgacaactactgttacctatgtaaaatgatctctatcaatctttgactaaatttatacctgatcctgttgttcttttgtttaaaatcttcccataaatctttggtccttacaggattatctgtaagagggttagcctggcaggcattttttttttttttacaatcagattcaacagagttcttttttggcttcatttctcactttgatcaaaatgacttctcagcatgcatgttcttacacacacacacacacacacacacacacacacacaacatacctacctctctgatatatgcttcctattaatttctgcctagaaaactcttactcatcctctaatacccatctcagatatatctcttgttttaacccttccttaatgtctctggtagaatgtgttatccaataaccctccctgtcccccgaccccactcaaccccaatgatcagagaacatattcctgttaaatcacctattttactgaaattatttcatttgtctctctcactttttagaatggaatcttcataaggcctgagatgctatttatttagctctgaaaaaactagccttgcatacaagtcttgtcataataagtcctaatgaatagttgattgactgaatgaacggatcttcacttgtggattttgcacaacctacagttgtgggtgccaactcaatgtgcagagttggaagctgtttgtagctctgccagtcagttttatgttctgccagcacattcttggttgttgtacattccccactgataggattttacccaacagtacttggcttgattacagtgttcaaaattgtttttcaccatgtctgggtttttttcccctactcgacttcattctctcagtttctgtacagcaggcttctgggacatcctgttgttacccattcccctcctgtacctcgcccatccaagtaactttgtgaggaaaggctgggagactggccaatttccagcatcttgttgctggtgatcctgtattactgtaggcatataagtggtgaacctgggcatgctgccatggctagcagtgaaggtgaatgcattccggtgccaataagggctaaggcatggaagtaaatccatgcagaattgactttgtcagtgctttctagtaaaggaggagtttatacatggaaagtatatcggtagcagttagcatcattttgtcccttatagttctagatgaaagaacaccaatatttttttaccttaattgcctagtaagaatctgatgttcgtagaaagttctgtacccttgttgcatttgctgcctagctcagctccgagacaggaaactgaattaggtatacagtcctagaagtcactgttgctcaaacttgaattgcacatggatcattaagggattttaattcagtaggtctgcggtggagccaagattctgcatttctaataagctctctggtgataccatgatgttgatattgttggtctgaaaaattcacattgagcagcaggatgtagagggcagagtgagctctttgacaagcagtgccagctaatgcgcgtaccctctacatcttgagtgcctcaacaatgccacaggatgacagagcatgccaaaacacaaaataaatcagttccctcatcaccactgcatgttagttcagaatgttactgacggtggtggaagcatccctgagttagtgttctccctcccacagagctcatttagattctttgtggagaagggaagaggttggcttccccaccaaatctttgttgaaaatgatttaacacattaaaagagcaaatcagtatcttaaggtttaaacttcttagctgcagaggaagttaagttcagttcccaaggacttaagggttcagtgaattttcaccaggttcttttttcacctaaacttcaagagcgcggtaggagagccatcatttattgagttcctgctatatgtgggcactgtttgttaggtgctggaggtacaaagaggcatcacacataatctcttgcccgagggagtttacaattgactccattaaaggttcaaattttgaggataaaggtgtgtcttatttgactttatatttcccaaagtgtaaaattaataactgcctattaactaaaatgttgctaaaccacagcataagaagagtgtattttaaggctaaatcatgccacaaattatgacatggttagtatagttacaagtgacaattgcatgccatttccattctgtaaatcagagcttcctaatactgctttaaacacaaaatgtgccgttgggcaaatgctgtattagcaccactagtactctgtttttcaaactgcaaagggcatcccagagttttaattttgtttcttggtgtaaatttatatgttctttggataaccacccaatttgtccatgtagccaagcttctcataggagagatgacagaggggaacagataactgtagaacacaagataaaatatgatgagggccaggacactgaaacacagataacgtaggtatcaataaactactacccatgacccaaatccagccagccacctgtttttttaaataaagttttattggaacacagccatggccattcatttaggtattatctatggctgccttcatgctacaactgcagagttgaggaattgcaccagaaaccatatatggcttgcagaacctaaaagctatgccttagagtctaagaagcaggctttctaatatttgtggggtcagggcaagaaaacaaaaagataccttccaactatgacccgccactctgctgttctcaccctggctctgtcctgcactgcgagaggtctcaaatacaccctacttatatgtaagttccatctactatcctcacactcctgcttcacaaacacctgtatcttgaccttctttcaaagaaaggggtgcacacacaaacattggtgtctgccctcagaaagtaaaccaatggaagaggcccatagaggccctagaagtggtcccagggaccccgggcggggcgttttaaattttggggtggcagatagtgttctgaaagataaaggacaatggctttgggcaggcacacctccttggttcccctagactccttgtcccatggctaaggcatggcaggaatagggccagagtagcaccccctaaagggaggggcaggaaacaggtttctctgcctgagtatgagggtgatattgttaaggagtcctgtttaaattggctaggcaaggacactattattacaaacagcttttagctagtgcttgatgattatgagaacactgttgtgcacaaatggtgaagagaggtattctaaggagaggaaactttatgagcaaagtcatagagatgaaaaagctttaaacactagtagagaatggctataaaagatggatttttacacctgtgaaaatatatactatatcattttatctttgcaacaggctctaatggctagtatggaaacttttctcttcagtggggagaaattgaaccatatattagttaaaattagaacctggaaacctgaatgcttgtttgaatggcaatgctatcaaaaatatcttgggcaaatctcgtaacatttctgcctatcagtttggaagattagggactcttgtcatatagatctatgatgattaactgtgtggagggtatcactgtaaatactaggaatttgttgtgtgctttaaaagtgtttcagtgtgatttgggagagaagagaaagaaaacccagctgtaagttgagaaccagtgctcagctgagataatggctcaggttgcctttattttaagattagacttaaactaaaaatcttctgttaattagtggctgagctggaattagcaaatagtcctggtcctcttgactttgggccctgttgtttgtcctgtgtatcagatttgataatcagcaacatgggactggatacaaaatctattagcctgtgggaaacagggcatgtattagaccagtggttttcaaatcttggtgaaaacagtaatcccctggtgagttttctaaagtgctaatcccttaaccaaaggtgagggactctgattcagaaggacggcctgaggcctgggaagctgcattttaaaaacatcggtagaaatttggataaaggtagtccttgggactcatgttgaaaagcagtggtttagaatgtgctttctttccttttggacagaagctctgtactgaagagcctttagtctgtgaaagacctgagttatttctccagggaaggtgactgtctttggctgaaccatccacattctcttgcccagttcctctgaggtctatggagtgcccatatatgagactaaagttaaggagtcacctccagccacgggacagaaggcagttttctgaccttatcagattttatcattgccatactttaacttgctgagctaaccagccacagttttgttggaactcaccatggagacagattaattttaactctgagagaacatgggcttttcaacacaagttaaatataggctggcacagaacatcacagaagcattaggtcctcagaaattttctttagctcccaaactttgagctgccactaatttatgctactcatactttctcctggtcatttttatgtttttgtcttcctttgatcactgaaacagagaaggcagtacttaacctgctggaaacaggtcatctatgagcatgtttctcctaaacaattacatggaaaattaatggaaagaataggctatatgtcttaggctcttgggcagaccataagctttcgttcttgtttttttatgttttcttgggtgaaaaacttagcttaaagaaatatgaaatgcatttaaaaattaatttccacaaaaccaaagtgctgagatttgaccaaatgaaaaaacttggaggtaaaaacactgcacggttccatgtgtaatagttttttttttcctggaactaaagagagcacacacatattcacacaattcctacctttagcagatatttcattaaaacaccacacaatttaaatgttgataagaccttttcaaatagagaaattaaaatgataccttattaactttcattatagggcattaataatttttgtatttctgattagaatatggatttttgttaatgtggtgattttcagtggcagtcatgttcagtgcaagtgtgttctacaataatattgagaaataggagatgaaagttaaaatactggtgatgatgggccacatatgacctacacgacgatacacagtagtgtttcaaaataccaataatttaataaattactaatactaacaaatctgtgataagataggaatttttagtgcttcgaatattgacctccctaagttacatttcaatgccagttgtacaatactagtattgaactagtgaggataagagtactagaggccattgcttgtgttacagttcacatcccggctttatgacctttggtgacttacataaactgtcgtctgtttttgttttttgttttttttcgggacacagtcttgctctgtcacccaggctggagtgcagttgggagatcgtggctcactgcaagctccgcctcccggcttcactccattcttctgcctcagcctccggagtagctgggactacaggtgcccgccaccacgcccggctacttttttgtatttttagtagagacggggtttcactgtgttagccaggatggtctcgacctcctgacctcgtgatctgcccgccttggcctcctaaagtgctgagattacaggtatgaggcactgcgcctggccaactgttgtctgtttttttttttttttttttttttttttttttttttacctacaaattgaatgaaattactcatagggttgatattaatattaagagagatcacatatgtaaagagcttagtacagtgtagtatagtgcaagtagttaataagagttaggtattagcaatatattatagtttcataatttttcttctaaaaaccaattgccaaaggatgtattcctttagttgaaatactatagctcgattgtgtatataaacatatacattaatttgtaaaagtcagtttaaaaataagtataatggcatttttgaaacatagccctataaataataaacatgcttccaagttctcaatggatgataaaagccatcaacaggcccttgtcctgctgagtttccctgtgaagccaacagctcagccagcccctcaaaggccatggaagcttgaaggtcagacactgcgtgtaggggtcacctgcagatttaactcttaaatgcgagtcgcttagatctgtggctgcatctatttctgtgaggtaccagacgtcttctacatttggaacattgatgatatgataaaggaagtcatgccaataatcatacccaaagctgcttaatgaaaggaagaatggagagtcacacaaacatcacctcttagtaatagaaacttgactgggagacccaagcgaggccccttctaccaccagcattcaagctgcattaaactaaaatgtcaaaaatacttaaataatagtaataataataattgtgtttaaggccatattcactgatcagtggtcctttattgatttagatctttacagaagtggagctcctgagttcattgcttcatccaattcctcgtttttattatttgagaaaggcactcccccaggggatttgacagattcacatatgtagttcaaaatggttgattagcatgtcatatgaaaacatatcagaaggactaagggctcttggacagattacatttgtagttttcctgatgtctttcaggcctatcattttgtcataaaatgaagttgaaagggtctgaatatgtagacttcttacaggctccatggagacttctcaccacttctgttttctggtacgtgcttagaaaacgactatttgttcctggatttatgtacagatcaaagcatcctggctgatttgttattttctagaatttacatttaaaagcgtgaaggtttctatttgtagaaaaggcatttttctttcttttttttttttttagatggcgtttcactcttgtcacccgggctggagtgcaatggcacgatctcggctcactgcaacctccacctcccaggttcaagggagtctcctgcctcagcctcccaagtagcggggactacaggcgtacgccaccatgcctggctaatttttgtatttttagtagagacggggtttcaccatcttggccaggcttgactcaaactcctgacctcatgatccacccaccttggcctcccaaagtgctgggattacaggcgtgagccaccgcgcccggccagaaaaggcatttttctatttgtatttgggtatttttcataatcccttactcattcatcagtttagaacaatatctaactttaattggaatgaatttcagtgtaaattaaacaattgcagcaaaaaaggagatatccataactaaatccacagtggaagacaactaatgagaatgcatagagagctaaagaatacagaactacatcagtcacagggaagtattcaaaaattgtgaaactttacaagtttgtttttcatatcttggcttcaaatttgtgttgctttcctccacaagggatttcaagagatgtttcagagaactttaaaactttcaataatgttttaaatacctggggaataaaaacaaaaccaacagtaataatgttggaggaggaggcagtggaaaggaacagagaataggagcaaaaagaaaaagatgttaacatccttaggtgctacaatggctgattcatctgtagtctcctattataaaatcttatgtggatttgggagtaagccccttactaccccttcccacccccatgccattcctatcactagtctttttggggaagaggctgtcattgacaagtccctactttcgccatactgttctctacagtttctaaattctattaaaatgaaggattgtatgataattctgttaatatttttattcttgaaatatttcagctctgccatgtattatcaatatggccttatctttaaaatgaggatgataataatactggcatcaaggcatgctttgagaattaaaagagtcaacccaaatatgggacctcaaatatagcctttagcaagcagaggctagctcatagagcatgcttgataaatggcaatcctcattgataaagctcattcaatggaatcacttatttttaaactgtagtttaaccagatatgggatcttactatccaattgaacctaggaaatacaaatgattataggcacagcctttccttggctttgtttagaatagttacagaaatagactaatattttggaatttcatatgttgatagattcaagtaatttgaatgggaaagaggcaggagagaaattattattattttttccagtcttgaaatttttcaaagcattttaatattctcaaagtaggaagcctgattagccttatcttcatcagttctttatacacatccctatatcactaacattttttcttatcccattcaaccttccagtccacttgtaaggctacttaaaagatgctagattaaagaatggtttgtgtcatcctcccatgtctttgacatctccatttttcttgaacctacaggggtaagtgagcactgcatgacaatattgagagaatagatatctttttttcacacctgtctcttcaagtgtatgattctgcttatctctttgtgacatttcagtggtatagtttctgcaaacatgattttatcaggactttgctttctgctttagacttgaaagtgaatttcttttgggatagttacatcttacttgttcaaggtgtgaaacataaaacgatatctgatttttcagtgttctactgatacacaataattctaaactgaagcaatatggtactcttgcctcctgcttttatcttagaagaatgaaaattgaatatttgggttaagttaatatacacaatacgtggattactaaagttattacattttcaatatcttatagtgcagtaatacatattttaacaataaagctcttaggagagtcacagtgtagggaagttatcttatctttacaacaataaccattatgtattgctctaacatgactttggtttaattgtactttctgaccatctgggtaacaaaaattattcttattggattggaccaagtgaatatttgatcaagaacaactttaattttcagcatttttttcaaaattactagggaaatgtaattgtaaacatatttttataaattatattttatttcctattctgagattataaagttaacttttcaatttcttattaacagggtgttgagaagccagattccacattaagccacttaaatattctgtgggtggactacagcaggaggtggaggagctcccatgtttctgaagatagtttgagataatattgtgggtggtgaaggggagggtacttacagtgtgtggagtcacggactcagcaagaatgtaatcctgctggctgcaccttcttttcctcacagggaattccaacaaagcaagaaggggtgaagtggctgagaagggccagtgccagtggtatgtgactccaggatctactcaaagaagtttgcaggttcatttgtagactcaatagttattttactcactaagttaaaggatttatgtatccaattttaacagatgcaataaaagttatttacattaatctttaccatatgtccctcttatcctttacattattctatacatttagaaatttataaaaatggtggtggaaaatacagaacatgatgtaaaatgtcaactcttatctcttttaaagaggttagaataggagatggttgattagtgcatctataaaattgtttacctgaaggccaggcatggtggctcacgcctgtaaccccagcactttgggaggccgagacgagtggatcgcttgagtccaggagttcaagaccagcctgggtaacatggtgaaaccccatctctacaaaaacaaacaaacaaacaaacaaaaattagccggcatagtggcacatgcttgcagtcccagctacttgggaggttgagatgggaggattgctggagcccaggaggcagagattgcagtgggctgagatcacgacactgcattccagcctgggcaacagagtgagaccccgtctccaaaaaaaaaaaaaaaaaaagataaaaaaaattgtttaactgagttgtgccgcacaaataccaatggttgagtgtgtcataatacttacagaatgattttgattgtgtacgtttgcttctctttacatgattcatgcataatttacaataagaactaccatggtgagctaaattaagtttaacattttgaagttttcttatgcagtggttatctgagtctccaagttaacttacattgcatttgttcactgtctccatttcctaagtcatattttagtagatgataccatgtagttttgcatttctatccaaatgcattttgcttgggagattagttgtatgaaatattctaaggggggcataaagaaggttctttgatgaaataactttggaacatgctgcttctatgtctcttacatggatattcacaatgataagtataaccaaaggctctgagaagtcctgcagtttaaaaaaaaaaacactaaagtgttttaacccaggattttgtagacacatttgaccataggcactctctttccataatgctttgttatatcctactgaactttgggaaatgccatcttagacatccagtaagatcatatacacttcaaattgcctaagtatttttacagaaataaatctaagaacataaactaaggtttgccagaaatatattacatttctctgttaaataaacgttttccattgcatgtcaatatctcacatgggaatgcctcttgtctccccagtatagtcaccagacagtcttcctctctggagtcctggtttctttccaagaattaggcccccatctctggtcttgccagattttacacccctcaagcccctcatgtcagggtaatctctttctcctctgggcgatggtgaggaagaattgggacgtgatgaggctctgtgagtctcaagcccattggcattcttacttttctaagatattctgcgtcttccttcagacttttcctctatttctttcaccacggattttgatggctcattaaacccagagcctgatttatccccttttggtttgtattcatagagggcttaatccttcaatgctccaagaaggtgagaaagcagattttcattccatctttccaatctagtacagaggaaaagaaaaacaaattcccatatgaaaagagtctgaaaatatttagaccatgatatagttgaaaaggcatcaacttcatttaccttttgctcttacattattttatcttgggcccagtctatctatctcatatcattgtatatcactctcctctttgcctattaatctccatccagaccagtctttaatccactttctgcttttgggccttttccctagctgtcctctctgcatcttccctgctcttcacattggctgtcccttgaaatacaaggcctcattaagtgtttcttccttggagaagtcttctctaactaccagactaaagtatctgactagtccctcacatgacatcttaattctcttaattctctgcagagcacctattgttatttggtattttattatttgtttatctgtttgtttcttccatcaagaatcaaagttccgtaaaagctcggacactatctttctccttctccattgcttccccagtacctaatacagtgccaggaaaataccacaggctacatagataattgctgaatgaatgattgaatatttgacttttcatgtctgttacttccttggttatttcttggcctttttttactgaaaatttcagtcgctctttggaggcattcgttgcattgtttcaatctcctccctctactcctgaccactctatgccacatttgacatggcaatgcaccttcctctttcttacctcaaattctgtggcacttttgaggctctgacttagtcttttatgtctctttgtattatgctaccttggagaccgcattcttttgcaaacttaaaagtacaaattctatggcaaaaacctttctgtaaattcttctttgacacctgtatcttaatcctgtcactcacttctctgctttactgtttcaatgttagcaaaattgccaactaaatctttagtttcttattgttcattgtggattaatattaagtccttaagcagactaggaatgtctttagggaaggaggcataccatgtccattatttatttatttttaatagcacacaacacatttcttgaacttaccatatttcagtggttcaataaatgcatgcatgtccatagatagacaatgtatactgaaaacacagcatcagtattaatttacgatcttagatgagccacttgtattgtttaatatattattggaattaggaaggaagaggcaggtggcagatccctatcccatactcccttacccccttcttgctttaatgtgctttcttttgccagtcttgcttcctattgtgcctttcccttcacatctaaatatacaacgttaagctagaaaagtactataagaatactaaacctagttgagaaaataaagagaaaaaaatataaaccatgggcaaatcgtcttcttgaatattcttctctcaatattttaaaattaagatgtatgattttgatgatctagaataaaaccaatctccctaacatattttgcatatagtatctgttttggccttttttcagatacagtatcatttcaagttattattgcttaagaaatttatgtttgtggtcacaaattcaaacattaccaaattgcaccaaataaaaaaatgaaatgaccttctctggttagattaaacttgtagcacatttattcctctaatatacaaaggttttattagtgaattgtttttttaaaaaaagaagataaatggaatccaacaacagcaatatatattttccagtaaaattttatctatgtgatcataaaattcatttatgctttttattaatcagtgagagaagtaatgctgtcagcaaaagtgggttatagctctatcacaaagttctaaaagcagccatggaacctatgcattttttcatgttttcagttaacattacttggggtataaaatgctattgtgttgtcaagtgaattgattctaatcacagctgttttctgtgaattaaatcaccaagaaaactcaatcaccaaccaaagacttttaaacaataaaatcccatttgtggttgaagatcaaatttaagaacgctactggatattcatttattttgtcacgtttaattttctactctgactctcagtttcttaaagaaacaaatatttaatatctccccaaagccaatatctgctgtgtagtgggttcatatcttagcactgagagttaaataattgtgtgtagaaaaaaataggatatacagtgattgaattttcacttcatggaaaatggcagaaaagctagctatttgcttgctttcattcctttactatttcagaaacaaacacatctctaacttcaagtgaaattaattagttacttagggagatatatatctatatatctctctatatatacctttgctttttgggttgtggcacttatgctaaagttatcctctgggtttccttatatgggtcatgccataaaaatatccatttgagggctgctcaggtgagactctctgagagagccgttatactgtctgtgcatccttcgtccttgtcacatcataatgttttcattcaacctctttgtacagatcaaggagagaattgttatgtatgtataaagttatgaattgttttgtactagcgaccaaactcagggaatttatcgcaacgggtattccataatggcttggcactaggtcagaagccattgtcagcaaatcaatttatgttacttagggtgtctcttgcagcaggacaggcagattcaggctgaaggtgttgagaaggctaaaaccttctcaaacagcagcgatgtttaaagtgtagctttattacctgcatacgtggcactgtgctggtagaaatgagaatggaagaaaaacagaacattggattattggttaaggaatggcattttattctttccttcataagttttatcttaaaccttgaacatctggctttgtgaaattgagccctgtgtctgaatgacacaacagaagagcaattgcaaagtcctgtgttcagacaagtcctgaatatatatctatttcattgtcatggattgtttatcagtggctggaatgattttatatgtcctttaatttaacaagcagtaccaaaagcaaaacagaaaaaaaaaactctttgaggctgcattttagaaattcttcagtgtcatctggcactggggacatttggtatttctttcatttcttgctgctataccctcttacacaaagtcacaggcttaagctgtttcccttcaactgtgggaaggaaaaaaattaatttgaacatttcatatattttaggaagagtttagaaaatagggtcacatttttcaaatgtgcacgtcagttgcttctcctccttgcctttttctatcttcaaatttgttttcctttagtagtttttagttaattgtgaatgtttacagtatggttagagataaaataattctcttacttttcttttccatcgtcacacctgagacaaatgggggaaagcagacttcaaaccacacacgatgtgtttgatttctgctcctttcaaatatccattttatttaccaagaggtaaaaacactctgaaaactggcaacatcttatgtcccacagcattacttttgatgaaatcctgctgtattttagccaaaacttctttagacaaactataactgagtcacgtcgaccctcagatgacatcaatcttcactcctcttctatccaactaccgactagacacacgtacacatgcgtatgcaccccacagatcaaacttatttcattttctctacctgttggtcacggccttttcttcttatagcttactttattcccattattagacctgtttccatgttactgaaccttttccatcaaacctcaagtcctttatctttgtcaacaactccgtgaagcttttatcaatctgcctgtcagtaatctctctcttatctgaactcggaatctataatctgcaacacggcacagagtatcaaactatgtacttgtttttgttatccttttagctgttttgtgtatgttgatttcccctgtaattcctcacacattttttgtagtccccaatgactctgaaccgacagcagttagtttttaaatatgaataccctatttaaggatcaatttctgcacactttcaaagctttctttaggataattatgtcaccataagtgaattaaggttcctcaccttctccatggagctttgcatagtactttagttggatcataaagaaatgccctgaattataggatgggatcactgcaaagtcctacttgcatgtgagcaaggagcagagtctctacaaggtaacctgttacttggatatctctgaggatattaatgataaaaaggagtggccagaggaaagacttttcgcttctcaattgcagcactgtaactaagtgacttctggtagatcaaatagactattttggggattcctgctcacccatctcctctgtgttttcagagctgctgtagagctgttagaacagtgaactgatgctttttgacttgccaaacagtgggagctttctatttaaatagttatcccttagaagagctatattagggagctcaaaggaaaggatttaagggcccacacagagtagagaggcagcagatcagccacctactgggcccttgttccttcgaatgcttcaaactacatatttgtaaggcagaaggcctcctgctcacagaactgtatgctcctcacctgcccttttgtatttagcaaacacatgggaagggcagctcttccctgctgtctaacttgtctcttgttgttcttcggaagcaatccctcacagcccagtgggcagagagccaggtgtgctgaatgcacctaggggatgtggtcatgggaggagatccttcaggggcaaggggatcaaatttgacttagtatgtggtcattttccaagtgacagatgtgtaaaatgccagtagactaagaacccaaaggagctaatcaaaatgcgtgtgtgtgtgtgtgtgtgtgtgtgtgtgtgttttaccaagaatctatataggtgctttcttatgcctttattaatatctgttcaaattctactaagtcatactgccaagcttattttgataagggaatcagtttatttatttcaccaaggttataactatattggatagagaaattgggattattttcttagcttttaagcccataataactttattaagtccacagagaatagtttatgctctattgttgctgtaataatttatttttcttgtacccattccatggggaaacatacaaacaccaggaagatacagaaaatatgagttagagttgggagactcactgtcctgccagataaaggtctctttctaaatctcattgaaacctgacattcagaagtaggccagaaaataggcctagctatctacacagatatctctttttgtattatcattaaacatctcctaggaggcagcaagctctgtggtgggctgacataaattctgccattacatttttgtttcttttttattatatgtgtattattatgaactattttaaacataaagaaaagctagaaaaatatgacaaaatcatttcaacacccagatttagcatatgttaatgtgttgtcaaatcttctccaactttctttttctctctttttttaaagcaaatgaatgttaaagatacagctaaagcctccctctccatcccctctttatgccactgtgtttcttatataattattacatataaggttgctaactcttaggagtgaatttctttcttaagtccaaggaccatctcctgtcttaggtttttcacaaaggggcaaatcagaacagtactactctactgagtgtcaaatttaattgtctcctcctctggtgtcactggtgtgcaaatactttcccccttgggaaggatatctggggttgtctaaagggcagcaatctctatctagcataacagtttcaaagtgcaagagctgtttatgacctacctgaaaccatgcaccactgtcattcagaccttcgccttttgttctgagccgccctgatgtgatcattcattttgctctgtgcctttttctttttagcatcctatcatgaatagcttgattgactcttctcatctcttgggtcctggatctacagaataatttaataaaatgaggtaaggtagattaataactggcttaaaatcagacttttggctatccctattttgtaactgatgctatactctccccactccctgggatacatcatgttctcttagctttgtgtcttcccaaatcaaaatatagaacaaaagtgaagaagtggaagttggcagctatgtggtttgggtattgaattgttcccacatcaaaagatttatgaactgtgcattttaaacagttctcagttcatggctccctttaactaaattgagaaaacaggtaaggaaagtgaggcaaatgctaaagaaaatggccttgactgttcaatctagcattaaagataaagatttaatgaaggtaggtttaggacttataattttgagtcttgaaaacccaacttttaaaggattaaacgggagggtggggagtaaattcaagtttatgtggtggttctcctcctctgtcgctcgctaatgcagctcttctgaaggatagaaatttaaatagaaagctctcactgcttaggaagcaaaaacattaagaaattgctttaacagctttacggaatctgccattttcatcctgactacagtgctacaaagtgagcagtaatctctggggtaggagcacggcccacagtcaacacctatgctcactctgtgctttttacacttttagttttcattttccttaatcaatatttaccaggcgacagtcacagctttagcagcttctgttttctaccaatctttctgttgctgatacttcagacatttaataatttccttgtctataataatttctgtgctagttccttttataaatatctgcagtatgtgtacctaatttctgggatcaggtgcacatctgaaaaattgggattccttaatgaatgttggcattcaaaaatctcctccagtactcttactttattgggtcacatcattttctttctttttttttttgacatcattttctttgttgtttattttaagcaatcctctttcagacaattgtcacttacaaggttagctactgctgtgaagcaaaccatcacaaaatgtagtggataaaacaataaggtcgcccgtctgagcagttcttctgatttgggctgggctaaactggatctcgctggagcatgtccaagtgtctgtagtcagttatagaggggctgcgggctggctcatctggctgtcacctgggtcatgtagctctgataatccagcaggtcagcctgggtttgcttttatctgatggtcacaatgttctgagtgagagaagaagaaacatgaaaggtctcttaaagggtaggctcaggactggcagattgtgatgtctgctgcaatctattaaccaaaagaagtcacaaggccagtacagatgtaagggcaggggaaatggactctgcctctttagtgagaagaatttcaaaatcacattgcaaagtgtgtggacacagggaggggcaaagaattgtggtgtttttgccatctgcctcttgcacttaaccttctcccatgacatagttgtctcaagtaatttcccttctgggagcagctgttttgatatacaggaaatattgatccatcatactctgaagaaaattgcagcacagaaaggattatttaggcatcataggtggtcatgagaataagaaatgctgaagccttaagcagatgagctttaagcagctgagccctttatgttcttaagtgaagcatttttattcttccaagcatcaactgtagtcttgttttcaccagatgaaagcaactccaagtcaaatgcatgaaactgcactaaaattgtgatgcatttggttactctgtatcatgtgtggacaaaataaataccctgatatggagcacagattatacacacatcgtttctctgaattcatagctatgcaaacagttccttacggttgacgggttttattttttatctactgtgattaagttgcagtttagccttgcattatctcatctaaaacattttagcttttctttttaattcttattctctaactcattaaaacttttttagggctttgctagccgattccatttcttcattttatcctaggaagaagaccagcaaaataaatgtggatattaaataatatgtattatcattttgcaaaatcaaaatgttttacatgagactactaaatagcaagttcatagtttgagggacgatgattttgccaatgagacagaattctctcataacacacttagggggcatatcacatgagggtaccttgcatagtacacaattggaaagtaggagaataaatagtgtgagtaggagacatttatgcaaagaaaaggcgcccttgtttcttgactttgctttagtatagaaatataaagtttgtggcttgaagggaccttaattatttcatggtttattcctgctaaaacttctaatgatgggaaactcactatacctaaagaagcaaagtccatttatctaagtggacgattgggtggtcatcactgggggaccttactatgtgtcattgtttttatcttcatgaaagacatgatctattaaagagatggacatggaaagtatcacagcaaaatatgctatgtaccaaaatataatacacacttaccttggggaccaaacggaaagtgaatttattatccagtttactagtcagaacttgataattctctaaataggtaggatagtggagatggaagagctaaagatggtagatgctgtctactgaaattgggactatctaataagcatgattaccgggagcatgtcagaacattctgtgtatccatggtggtcaatgacttaaatctacatccattttcagagatcaaattccattcctggcccattacagaaacactacctgggcctcgagtgagcaaatgccaagaagctatttaacaataggcaagcacggcaaagagaggcttaaaattggcgaaaagtgcttcctttgcagtcatcctattcaacttgtggcagctttgaaacagcatcatgaattattattttaatattacaaataaactttattcttctcagcaacttgcctcctgatatgttaaaaatatacaaaactcagtttgtcaattcctgggaaattattgtcatagcggggagccataccaaggaagtttaaaagaacaatgataacaatataaaaaactgcaggagaaaagccataaagataggtttcaaggcacacttttctatcttccttttcactgttgatttgcagtcagtgatagatcgactttttttttgtttgtttcatttgtcctcttcctttcactaatctgggctttatttttgtttcaattttccctagctttcttcccagataataactatttccttttcccaagccctaattcacactttatcattctctcactgaagtgcctttcacagcaatccaatcaggacacttctgttcagtttgttccaaggggcttatttgatcatcatcaagaagataattgtctatccttagagctgggctaaacaaaagggtgaagcaggttgtgcacaaattcacaagactccattatcattcccctgcagactcccagctgcacttttactcaacccgtctgccttcttccccttcaggccaccttggttgagcttcttcagctgtccctgcttctatttcatccacctgttttcatccttcatgctttcctaattcaggttttctattcgtctactgcaactgatattttctagcaattttaaggaggataaaaataattcttgagtgaaataattcatactaggctgagagtgaatgatttcagatgtataggaggtgtgttataaaatgatttattaaatgtgaagaaattcctagtgaaaatatacatcgatatattatgtggggatcatgggtgcctctatgaattaattcattcagaaatgttcattaaatgcctaactcattgctaacggtgaagaagccaaacatattccctttcccacctcttctcatggagcttacattcaaatgggcaagataggtagtgtcttagcctggatttccctgtaataagcagcgctaagacaaggctttagatgcaggtttatattgggaaaagaaaccaaaggatcaggagtagaagatggataacagtgagagaaacagaaggaaggaagggtatgtcactgagctagactcaatcccatcaggagcctcttgagaagccatacagagtgtacagtgggcttgtctgccacagatacctattggctccatcccccattggtcacaggctgccccacacatggttcactgtcttgtgcctgtgctttttggaatgtgtcagttggttcctgaaattgtcccactaagatatggcagagaaataaatagtataggtgaggagagacattttcagaataatctgcacaaagctgatggttgcaccaacagctggaatataaaggtaaatgaagaagatataagaaagggctcaagaggtgtccgatacaaagagcaataaaataaaataaatatctaattgcacactgtaataagtgctctagggtaaagggtaccaggagagcatatgcacaacacaatccaaaatagtggtatagaccataggggtgaaaaattccttcaaaccgtcatggttccttgacatgaccaaatgtttgtagtgctactaagtaaaatgtgttgaagattaaagcccatttttaattttactatttagctatcctgttcctaggtaaacgtcaaatcccccaaatctttaagcttttctccaaagtagattttcttccaaagattaagaaggtttcaacactattttagacaaaggacttctgactatcctaatacctccccaaactactacattgaaaaccttattgggagacataagtactcctagctttgtttaacgttaagtggaaaaaatgtaatatagttgagaggtcaagagcctgtgctcaaaagactccgatttaatattggcaagactcatgagctatacctctttgtatctgaattccttatttgtgaaaggggaataacattatcacttgctcgcataggttaaaaggtgattaagtaaggaaacacagataaaacttatagaaaaatgccaggcatatggtataatctcacttattagcaaatgtattaatttactagggctgccataataaaataccacagaatgggtagtttaagcatcagaaatttatttctgtacagttttggagtctagaaacccacaatcaaggtgtcgttaatggtggtttctggtgaggcctcacttcctggttagtggatatctatctgccttctcactgtgtctttatatgatctttactgtgtgtgtgcatcctttggtatctcttcctcctcttataaggacatcagtcctattgtattagatcttcacccttacaacctcatttaaccttaattacctctttaaaagccctgtttccaaatacagttacattggtgggtagggcttcaacatgtgattattatgggcccacaatttagtcaataacagcaagtggtgtaatttttacatgaaaatgtcatttcctagaagggggcttttaaaaactttttagtctcaggattcctgttatacttccaaaaattcttgaaaatgccaaaaagcttttgtttatgtgggttatatctatcgatatttaccatgtcaaacattaaaattgagaaatttaaaatatatgtatttatttatttgaaaataccaataagacctcccattacaaattaacattattttagggaaaataactacattttccaaaacaaaataaatttagtgaagagtggcattgttttccagttttgtaaatctctttaatatctatctttatacaagctgctgaatttgcatatctgcaactatagccaacttgttatgatacctcatgaaatgtaacctctagaaaacttcactgtatgcttttttttttttttttttttttgacggagtctcactctgtcaaccaggctggagtgtggtggtgcattgtctgctcactgcagccttcgcctcctgggttcaagtgattctcctgcctcaacctcttgagtagctgggactacaggtgcccgccaccacacctggctaatttttgtatttttagtagagacgggttttcgccatgttggccagaatggtctcgaactcctggcctcaggtgtcgtgcccaccttgacctctcaaagtgctgggattacaggcatgaaccaccacactttgctacactgtactcttttgaaagaatgagagcaaaaaaggcaaatagcattttggtattattatgaaaatagtacagactttgcagagcctccaaaatctcctgaggaccattggtggtccctgtagcacacatttgagaaccactgccttaaagcttaagaacactcccaaatcaatgaggtttgtaattttggcatcctacttttgaaaggctccccaactcctttaagttcaataccacattttagtgttttgtgctaataatagtaaatattgacttttttccacttgcagagaaataccaaaccatggcatacagatggatttcacttgcaagttatatttgatgatatttttcactttatacttcttcattgtccacaatgagaatgagacagaactatttttgtgatatctgttgggcaatccttcagtgaactggttcaaataatgtgttttcttgaaaactgctgctgtaacatatctgttttgctactaaagaaattcagcctatgaatattattacatctttgaagtgaacttcatcctaatggtcaaaaagttgggagccaactgtattgaacatttattttttaccattatgtaaaacagaccattcatttactcttttgaagatgacaatttaatttgttaaagttttattttatttttaatcgaaaaataattgtgtatatttatgggatgcaatgttattttaatgaccacattaggccacatttcaatagctgataaaaaagttcccaacacttaattgcttttactaaaaatactaaatatttaaagattgattatatcatagaatttttttttttaactgagacgcaatctcattctgtctccctggctggagcgcagtggtgctatctatctgggctcattgcaaccttcacctcccaggttcaagagattctcctgcctcagcttccctagtagctgggaccacaggtgtgcaccacaatgcctggctagtttttgtatttttagtagagatcatgttggccaggctggtcttgaactcctgcaacctcaagccatctgcctgcctaggcctcttaacatgccgggattacaggcatgagccaccacgccaggtctggttttggttatttatatatatatgtgtgtgtgtgtgtgtgtgtatatgtatatatgtgtatatatacatatacacgtatgtacacgtatatacgtatacacgtatgtatacatatatacgtatgtatatatacacgtatttatatatgtatatatgtgtatatatgtatatatgtgtgtatatatgtatatatatgtgtatatatatatgagctcctcaagcacagaaataagtcataaatactgtttttattttccccaactcctgccaggttgaatttcagagttgatgcttaataagtaattttgaaattaagtttaatagaatatatgtaattattattttgtgtcacaatgattctaccatattccctgtctttctaattttttagtccttcttttgttttattttcccctcattttatcacgtttttctcttacttttattctttctattttttttaacctcttatcaatcactttggactcaaactttctgaaatcacgttctttactttttaattaatatttgttcctggttttacaattattttaattatatcatttatacctacttttctcagatattttcaaatgatatttggagacaattctccatatggcttagcttttctgtatgtcttgttagaagaggcaccgaatgccttttttatgaactctttgcactatcttgggagatagaaataatatctccctttggagcaagaggaagacatgtttattgtttactgtgaaagatttgagttctctaagatcaaagtttctctcctataatgtacctattgcatgtgcaaatatcatccatctctcttcatgtcaacctgtaggaattagaccttgggaaactggcacaaaatgtgagtactctggctactgtttttgctgtgagtaatgtttaagccattttttgtttctgactcaagagtttcatgtcttctgttggcatccatgaaactgtggcaggctaacccattaccttgcaagtagggtacaatctcagattttgttatagacatcaatgacttacgatgatttgatctttgacttatgatggttcaacttcgatgtttttactttaccatggtgtgaaagtgccacacattcagtagaaactgtacttcaagtacccatacaaccattctatccttcgctttcagtacatgaggtaatcaataagttgcatgagatagtcaacactatttttttatatataaaataggctttgtgtcagattattttgcccaactgtaggctaatgtgttctaagcatgtttaagataggctaggctaagctatgatgtttggtaggttaggtgtattaaatatatttttgacttactatattttcaacttacaatgagtttattgggacacaaccccattgtaagttgagttatacatgagttaaacatggttggagtttgcggctaaagcttttggattacttttaccccatcgtaactttatcatggcgtgtgtgtgtgtgtatgtgtagcccggcaggcatggccatccactgaatactttgtcttgtattataattgctcttatttttcatattacataggcaagtttccttcacaagtacagtgttttcttgtcttcctccaagaactttttactctcctttcattgtcaggtctcattataaggcttagcagattcattttaaaaagcaaacctattattttttgtatatttatctagtctattggtctatccgtatttttccatatctccaaaagcatcagcatagccattcttacccacaaagcactgttgaccaacttatgtttagatgtggcattattttcccacctggaatgtcatctctttcttttatctatgtttcttccatttcttttaaaacttactttctctacagaggcttttgtgagtaatcccaaataagtttactcattaagcatttattttttgataattatattactaatattcattgattgcctactataattccaggcagagtgagcaaaccaccacagaacttgaataccatcttggaagttagtatcttataaatcaacatacattcaatttgatctatgttatttggatttaaagatacataattttttatttttcatgttgcctccctgatttcattggaaattcttccaaggcaggcaactgtgtctttttccttaactaataatagtttaagcccataaaaccttttctctctcttcaagcaataagaaaaaatcaggctgtccagcagtgcagtgcaatgattccatcagggacttgactaccatctggctttctgctccaccatggttagtgtgtggctttcagcttcatgattgtaattgggctgatatacctctggacctcatggccatgttcaagggaggaagaaggaataagggatagagcaaaaggggattgtctggggtcaaaatccttccaacctgagacatcaatttcagaagttttccccaaaatgctatataacattgtctcactgatcacaactgggtcaatcaccacccctagctacaaggaagtttgagaaggtgaatacgcttaactaagcatatggacactttacacaaaatcagaggtttttttaaataagaatgggacaagatatgttggttagagactaacaatgtttgccgtaccaccaaactcaacagtggcataaggatccttaaagctacaggataaataaaaagcatcttcttagagcatcttattagaaaatttgaaggaaaacttctccctaaaacaaacatggggtagaatacagataagatatgaatatttaaggttgaaattgggtgagataaaaaaattctcaccttttgccatgtcccccacctccttcatgtgccacagccacactggtgtctttcatttcttattctaatcatagccctttctaatctctgatttttctgccagaaatgctcttccctccaaattttaaataaatgggcagatctcaactttaaacttaacaacaacaacaaaaaaggttctcagagagatattccctgtccaaccagatataaaatcccagtcactttctgtgatattttcaatttagtatttatcactacatgtttattgtgtgccctccaccccacccccagaataatgtaagcttcatgcaagcaaatgcagttaggtgctgtttatcctagcaaagggcacaggaaaaggtaggctctcagtatgaagcagggcacaagaagtattcaatacactgttagattttcactgagatatttatgcttgaaactaatctggagtctttcttctcctctcttagaacattgcatcaaagaatatcaagtcaataggatattggatattttcagggaaaaaagacaaagactaggctgattgaaaatcactgtaacatttgttgtaaaacattgtgtttgcgtcctactgttgctgtataaatatattttcaagctctttttgtgaatatcaaatgaggaacaatagacaaaccactagcttgtgaaaacattttgatcccattttagtcaatgattaattttgtaagacataaggctttgcctctgtcttctcactgccaggccattattttagtgttcatccccaaaaccatactttttaaaaactggatattaatgccatgtaaatgttaagaaaatatttagctcaggaattcatagacaagattcttgttgtatatatcttggaatttttcttgggacacaactggaagtttctctatttattcaggacataaaataacccacttcttagggggaaggttccaggtcaacaatttaatgatttttaaacaaatatcctacagggaaagggaagatttagaagaattttttacatccctttatacttcattaaagcctttttggtgtatattgtgaaattatatgcctagtccagaattaaggacctggaataggctaaacaagaaaatacaggttagtagagttataattaatcctcataagtcagagaataaaatgggcaagaagagtagtcaagtacattgaatagagtcttccattaacgtaattcagaattgccctggcttcccaagagcattttcatgtttcactggtcaagtgaaatacctaccctgtcttatctcgatcttcccacattacttacttccttattaggttcctctgtaattctattgactgaaaattcactgctgtggaaatatatctactagtggagttaatccaaacaatttgggcaataggaaaaatacatgcttaatgatgtgtttgccttctcacttaattttatttcagacctactagatagtcaataagggatgggaaatgacattcttgtgaaggagagatgaaaatattaatatattaatattatgtatttaagcgtagggatgatctcgatataggcatatcataaagtaccttaatatttcattggctgattcatcagagtgaatctatgtggtcgtaaatgaatgggaagcatgtaaaaatcttgtttatctaacatgcacactaaaaagggtcctccaggaattagaatcactcaaaattgtaagttgtgccgcaatttgttgatgtaattatatcaacatttttcttgacgtcagaccattgtgggtgggaagattatggttttgatgatcacacagacataggcttgaatatattctcttattgctggctgtgtgaccacagacaagttacataaacactctgactctcagattcttttgtaaagtgggactcctttcctttgaagcatgagcacaaagattgaaagatacataaaacactttaacatgttgcctggcatgaaacaagtgctcattatgtattaatcttcttcccattctccctctgggagcaatgagtgatttagagtttgtaattcagttgagaagaaatttcagaattgtataaaaggcagtgtgcttatatattcattcattagtccccttattatcagagtgtgttatttgcattacatagtttagccatggtgtgtataatttgaatttaactggaaacaacattcctttcacaaatgttgtttccaactcaattacctgaccttcagctaggttagaagcattggcatttctagtaattttgaaattccaaaaatgtaacccccatactctatgctaattttcaaatcagcagttgaattggctgctcagtcacatttgttcctaaagacggaaaataaaagtgtctgtgagagggcaggcctggcttaaattctgtcttaacttgaaggatctcagaagcagactctgagccagggattccagcgcaagtaatttattaaggaagtactcacaggaaataccagtgaaggatcaaagaagcagaataaaaaagggaagaagccaagcaagggttcaatttcaggtgaagtctctgactcagtctgatcctgtggtgagccctggaacaaaaattgtacctctgagtttgtcttgtctcaagacataggaactgtcttcttataatccagagctagtcaatcatgaactgtagtctgtcccaaggaacataaactctcaggaacttctggttctaaattagggtgagacaactctagtatccaaggtcaagttttagaagtttctgctgtaagcccttatcatgaattacagaacatatgggataaaacaaagcactggtaaaggaaatgaagggtataggagcagatcactaattgtgtccagtacactcttctaggtcccttgcattttctgaaccaggaacatatagtggccatcatagcattactagttcccagtaaggtaaattgttttagtaagtgaacagtgcccaaatatttaggacttacttgaactgaacgttgcatactatgaataggctatttcattgtaccttaagggtttccaaggataatgtaaatatatgaacaattagtactgttatgatgaccaacatttattaaacacataggatatgccaagccatatattagatggtgtatatagtttcctatggtctgttttttgtttgtttgttttgttttgttttttgagacagagtcttgctctgtcacccaggctggagtgcagtggtgtcatctcggctcattgcaacctctgccccccaggttcatgcgatcttcctgcctcagcctcctgagtagctgggatgacaggtgtgcaccaccacacccggctaatttttgtattttttttttagtagagatgaggtgtcaacatgttggccaggctggtctcaaactcctgacctcaagtgatccacccaccttggcgtcccaaagtgctaggatcataggcatgagccaccccgtccagccatatatactttattatcttatcaaacattagaagcctcattttagtgatgaagaaactgagcctcaggaaattaaaaaaaaaaaactcataactagtaagtggttaaactaaaactatattcctggtgtaatccaaaaccctagatccttccaataagcaaaattttgccctttaattgcagtaatagaatctgtgaaacactaggaagctaccagtattacttatctatgctgcatatcaaatccccaaacttaaaacaacaacaaacatttatcatcctcacagtttctttgggtcagagatttaagaacagcttatctgggtagctctgacttggtgtctctaataagatggccataaagattttggctagggctgcaatcctctgaaggcttgactagaaatgtaggattttttttttttttaattatactttaagtactgggatacatgtgcagaacatgtaggtttcttacataggtatacacatgccgtggtggtttgctgcacccgtcaacctgtcatctacattaggtatttctcctaatgctatccctcccccagcccaccactccccaacaggccccagtgtgtgacgttcccctccctgtgttcatatgttctcattgttcaactcccacttataagtgggaacatgtggtgtttggttttctgttcctgtgttagtttgctgagaatgatgatttccagcttcatccatgtccctgcaaaggacatgacctcattcttttttatggctgcatagtattccatggtgtgtatgtgccacagtttctttatccagtctgtcattgatgggcatttgggttggttccaagtctttgctagtgtgaatagtgcgtgctgcaataaacatatgtgtgtaagtgtctttatagtagaatgatttataatcctttgggtatatactcagtaatgggattgctgggtcaaatggtatttctggttctacatctttgaggaatcgccgcactgtcttcctcattggttgaactaatttacactcccaccaacagtgtaaaagcattcctatttctccatatcctttccagcatctgttgtttcctgactttttaatgatcgccgttctaactggtgtgagatggtacctcattgtggttttgatttgcacttctctaatgaccagtgatgatgagtgttttttttcatatgcttattggccgcgtaaatgtcttcttttgcgaagtgtctgttcatatcgatgtgctgtattcaggagacccatctcatgtgcaaagacacacataggctcaaaataaagggatggaggaatatttaccaagcaaatggaaagcaaaaaagagctggagttgcaaacctagtctctgataaaacagactttaaaccaacaaagataaaaaaagacaaagaagggcattacataatggtaaagagatcaatgcaacaagaagagctaattatcctaaatatatatgcacccgatacaggagcacccagattcataaagcaagttcttagagacctacaaggagacttacactcccacacaatagtagtgggagactttaacaccccactgtcaatattagacagatcatcgagatggaaaattaacaaggatattcaggacttgaattcagctctggaacaagcagacctaatagacatctacagaactctccaacccaaatcaacagaatatacattcttctcagtaccacatcgcagttattctaaaatttaccacataattggaagtaaaacactcctcagcaaatgcaaaagaacagaaattataacagtctctcagaccacagtgcaatcaaattagaactcaggattaagaaactcactcataactgcatagctacatggaagcagaacaatcctctcctgaatgactactgggtaaataatgaaattaaggcagaaataaataagttgtttgaaaccaatgagaacaaagacacaacttactagaatctctgggacacagctaaagcattgtttagagggaaatttatagcactaaatgtccacaggagaaagtgggaaagatctaaaattgacaccctaacatcacaattaaaagaactagagaagcaagagcaaacaaattcgaaagctagcagaagacaagaaataactaagatcagaggagaactgaaggagacagagacacgaaacacgaaaaaccctttaaaaaatcaatgaatccaggagctggttttttgaaaagatttttttttttttagactgagtctcactctgtcatccaggctggagtgcagtggtgtgatcttggctcaatgcaacctccatctcccaggttcaagtgattctcctctctcagcctcccaagtagctgggattacaggcgtgtgccaccatacccacctaatttttgtatttttagtagagatggggtttcaccatgttggccaggctggtctcaaactcctgacctaagatgatccgcccgccttggcctcccaaaatgttggaattacaggtgtgagccaccgcacccggcagtatgtattataggatctcctatcagggtgtcccactcatagcattggcaaattaatgctggctattagcaggaagcctcagtttcttgccacacggacctccccatagtactgcttgagcatgctcaagaaatggaagttgtttgatttttttccccagagtgagtggttaagagaggacttttggaagccaccatgcattctgtgacttagccttggaagtcacataccatcacgtctacaatatcctattagttacaagatgaaacctattcaatgtgtgagaaaactacataagggcatgaatagcaggtggtaaggatcattaggagccatcttgaagaatggttaccacactaccattcctttcttcttaatcctaagtatagaactcctgctgtctcctgaggatttgttaagcactttgttgctcccacatccccctcaaaaaaaaaacttaattaaaagtagctaagtagaaacaaatattcaacacactagtaataaatgtagatgttactgaatatttagaaaggagatcaagaagaggactgacatcacacatcacttgatagaaacaaaattaatttttcttttacatctgcctgctttcccttcccaaatccctctcttcagctgccagctgtctcattcctctttatctctttcccacatagcctcaaaactctcctttgttgtgccaaataattcagctctggtcctgagtttacaaacacattcttggcaaaacaaaatcctgatggccattctcactttctttagaatgcaaacatctttgccctattatggaaaatagggatcaaagtagcttattgatatttactcaacaaaaagtcctatttcctaaggtggagggagagagacaaatatgttctcttgttcagaaaataagtttttttctcctaagtgttatatatatatataatatactcttctagcttccagatccagggaggacagtgatccttctgtttcttgctgattggttgctatacctgtttgaaattatagctcttacatttttgtcattgagttagttgctgatcagttgctatacctgtttgaagttacagatcttatgtttttgccattgagttagttacatcctttcttattttgtcactgagctcttaaccagctagcctacatctcatcttgtttagaaatattcttatgatttctgtttttcagttcacctgattctggaaaagaaaagaaaactttgcccctgaaggacgcaagcaattatgagtggatactacataagggccctagctttgtcatgctcgttgatacacactcccacctagcgccttgcactcagaagattcagttcatatatctgttaattgactctaactgactgaggttccctggatgaggagagcaatgagaacagaggcttgtcagcctgcataatccctactaataagctctactatactttgatgcttatcttcattttcttaaactgaaaaaaaaaatcttttggcaaattccaaaggagatcatcactgaaatcttgctgagttcaacttataagcttgtgggcattaaaaattatatcaatgaggtcgctgccctgtaactgttcacacttttatttagaggggaccagcaagttatgactgtagaatgttgataccagttttgagaggacaggtttaatgaagcacatcttatgcctcttcatccttttcatactcatccataaaatatgagctctattggctatgtagtaattaaaggctgaaaacaagaaggggctattatgagctaagaagaacggtaagacatttatttttgagggtggcataatctctttggggaaaaaaagtatggataaaagggagaggggccaggcgcagtggctcacacctgtaatcccagcactttgggaggccgaggtgggtggatcacctgaggttgggagttcgagaccagcctgacctacatggagtgaccctgtctctactaaaaatacaaaattagtcgggtatggtggcgtgctcctgtaatcccagctactcgggaggctgaggcaggagaattgcttgaacccaggaggtggaggtcgtggtgggctgagattgtgccattgcactccagcctgggcaacaagagtgaaattccgcctcaaaaaaaaaaaaaaaaaaaaaaaaaaggaaaagaaagagagagggaggtagaaatgaaagggtctattcagaggtgattgcaaagataaatctagatgtcatagagggaaaagtagtgagagggaaggctggaaaaggaggtttctctggattctagaggctcttgagttgcagatcaaagcttggattttatgctattggcgatgagcagtcattgatgacctaaagtgacataataatgaaaatactgctttgggaaaggtaacccgggtcaccatgtatatgaaagattaatgtaaggagaaattgaaagcaggaagagtaacaggaaaatttcagaaatttagaaatgagagagaagaattgagcctatgaatattccaatgcaaattaatgttctattttttctttgcagtttctagtttctcaaatttaggcttcatgcaatatgctttgaaaatatgatgattatattaattcatagaatcactgattcctcttctaccccaccaatgtttgtaaggtgcattctgataattttattaaccatacctcttcgtaaaggtggtaaaatattgaagctcttaaagtggccttggcaaatgcatataacctgtgagtgtattgtgcttagaattattataaaatgatttttaaaggatcttcacccaggcacagctaatatgagtaagaatcctaaatgtaagttacttctagaccagtggtccccaaccttttaggcacccgggacaggtttcgtggaagacaatttttccatggacggggtctggggggtgatttaaggattaaaccgttccacctcagaacatcaggcgttagttggattctcgtaaggaggatgcaacatagatcccttgcatgcatgtgcagttcacaatagggttcatacacctatgagaatgtagggcctcccatgatctgacagtaggcggagctcagactgtaatgcttaatactggctggccagccactcatctcctgctatgcagcccagttctgacccaggctgcagcccaggggttgaggacccctgttctagacatattattgcacttgtatcattttactgctaatatattactgtatcattttactacgaatatattgtcacattataataaattccagatgatagcgcaatcacagcacaaatacttatcttttctaaaaaaaattccagttgtagatttgttcaatgcaatgtggtatattttatctttctaaagagcagagcagtgtggcaattctgaatatacacgtgcttgctgaaagcgataaattggtgattttctccttcgtgggacagaaacaagtgagatggatataaagagaaaatcctacaagtaataattttagagcacttcttagtagcaatttcaatttgtcactagcactctatgtattcccaactgttactcctttcattccataatttttattctcagatctttccatttcatatcccaaagataacatttgctcaaacataaaaataacatttagctgcctttgcatggcccttgcaaatttatctctcacttcttgtttcccttagttccccagtagccttgaaaaacacccaagttggctgaattctaagccgaatgactgtgatagctccacagtagcataattccaaatgcttatttgatagctccaattgatggctaattggcccttcaaatttaacatacttaaaaggaaatttctgtttatcctctactctcagaattgattcttcttcaacttctcctcctagtacatggcactaccattagttggctgcccaggttaagaaaatcatgctaattttaaaaattaataataaataaaaatctagataacatttatttttcttctcattccctaaacctctacctacaagtatacaatcttccagaaacttcaaactgcaaaatatattccaaatctaatcacttgtctccttttctgctgcccccaaccttagtttacatctctcttcagctgtccttcaggtgtttcctcatgggtctctgttctcttgtttggcctttgatccacactcttcacacagtagtgttgactgtaggctccccaaatgaacaacagaaaaaccttttgatcatacatatttaagtttttggaccttctgctgtaagaaaaaaacataattctacagagtcttagtaggatctcaaaatgggaaaattagaataggttatttattatattttacagcttggtctgggttatttcaaggtgggtcttgttaggcagggattggttaagtttggacaaatttcattgcatagttttgaattgtcggatacatttgagtgaatggatttggattggtgggtactgtgagacaatggttttgaaatgagttgtgacaaatatgtcactgagtcagttcatagtcatcttttaggagcaggtgtttcttggaccaagcatctaggttattttggcttggagtaaatattctttaatatggagcagaaatgtatgcctggttctagtttcatagagagagaaaattatgcttcataggtatttaaacttaaaacatctcttcatatccctgcttataatccttggaaagcttcatgctatgatcagaataaaatttaaactcaaattagaagatcctaaataggctgtcccttgtctcctcactgacttcagttcttaccactcttccccttactctccacattccagccacactagcctttcctttccttgagtaaaccaggctcgttcctgcacttgcgaattgcctctgcctggaatgggtctttctctttcatcatttgaagtctcccacaaatatcatctcttcagagaagacttcttaaggctacccatctaaatcagctcatgactcccatatctcttcactttagagttcatggcactcatccctacctatacaaaattatggtcttttaagcctgatatcctctattcaaatctttcttctgctacttattagcagtagaaccatgactatgttactttgactatctgtgcctcaatttcctcatacattaaaaaaggacaatgatgatacatatgtcatagggttgtcatgagccataaatgaatttagctttgtaaaatgttgactctctaaatattagcaatacaacttgttggtaaaataactgtgataaggaagaccactacctcaggagaactactttggttttgtctcccaaaggtgaaggcaaggtcgggatttattgagaattggaagtttggtttaaggtggggttttttcaaaaagaggattttattaagattgggtatgaatcaggatataacagtctaggattggtgaaaacaggaaagccaggattttgagacaggatttcaaaaaattgtactttgtaagttctctgttgattctattgaaaagttgggaagagatgggtcttttggaaagtccctgtaacgaacaatcaaaccacttgcttcagccagaaactcagggaaagtaatgacagtgggatacaaagttacattatcgtggaggtatgaggttagggagctttagtcctcaatatccaagctgaatatacaggtagatggttttggtgctcagcatgtaaagcatatagaacagtgcctggcacataataagagcttaagtaaggtgaatttcatcattaacttattattgtcatggaagccacaagggtggtcatttgtctgtatctccatttcctggcacaaacattgcttagcacaaagtaggtactcaataaatcattgtggaatggataaatttatttatttactggttttctgtttgtctccctaattaggatataaactctgcgagagagaaaaacatgcctttattgttcatcaaagtattccaagggcctgcggcggtatttggcccacagtaatcacacaaagtgtatttgttgagtaaattaataagcttttaagtatcacaaaagaatcttgagtgtaaaaccagctcccagtttctttcacctccactgaaaggtgtgagtccagaaaacgagaacaaaatgaagaacagaagaataaaaaacccagttacattctaaaataaattgggggaaatgctggtttaaaaagttaagtaagatcctttcctgtaaggtttctcagatcctttaatctgccaatgtgcattgttgattactaatgggaaatagtgtgtatacttgtttgatcagggaacttgtttttcccctttttgatttgagaacacttatttgcatctctggaaatacaacattagcgttatttgagatgttctttgggaaatgctgtattaagcagttttatccaaagtcagggatgccatcataggaagccgaatgagactccttggcagtgatctggtgttgagtcacttcagggtgatgggagaagcacagatgaaggcagtcccatcctgatagggctagggctcctccagagactgcacataagtgccctgtttgctaccagaaagcactcacatgtgagggagagtctggtttaatgtccccctagttggtgaacactctccaatcttaaccacaagtttcccacgtgtctctgacatggagtgccatgagagaagagttttctactagatactcaggcagcattttgttcttttacttggccctcacgtgtaccttcaacttgggttttacccctaaaaacttatgttgttgtgtttgggggaagtcaaaaccaggacacatgaaggattcatattctggagcttgtctacttaaaatgaccaatgctttcaaacaattatttcatattcgtatgcctcagattcttcaggaagaaactgagtagcttgaatgatagtcatgggttctgaattgtacattgtattagtccattttcacattgctgatgaagacatacctgagactgggcaaattacaaaaggaaaaggtttaatggactcacagttccacatggctggggaggcctcacaatcatggcgggaggcaaggaggaacaagtcacgttttacatggatgacagcaggcaaaaagagagcttgtgcagggaaactccaccttataaagccatcagatttcatgagacttcttcactatcacaagaacagcatgggaaagacctgcccccatgattcaattacctcccaccatgtccctccgacaacgtgggaattcaagatgagatttgggtggggacacagacaaaccatatcatacattgaggaattttagtttgggcaaggcagggaggtgggcctctgggagcagcaaataggcaactcctgttagtgcctctaagtcaatgcaatcttgctcttatttgctctatgcaactttattagaagagaggaagttcctacttaaaaggtagtttttattagccccacctgtgcaatttcacttgaagacatctgctactaaaagtagtttgaaaactactgtactaaaaaatggagtccactgtctttttttgtatggtctccaagctaacaaaggttttgatatttatagatggttaaaaatgtcagaaaagaggaatacaaattaagcattcctaatctgaaaatccaaaaatctaaaatgctccaaaatccaaaactttcctggtgctaacatgacttcataagcggataattccatacttggcctcatgtgactgggtttcagtgaaaatgcagtcaaaatttcattttgtgcacacaattattaaaaatactgtataaaactaccctcatgctatgtgtataagcggtatatgaaacataaaggaatttcttctttagacttgagtcccatttctgagatatctctctatgtaaatgcaaatattcaaaaatcagaataaatcagaaatttgaaacacagtctcaagcatttcagataagggatactcaacctatattccattatgcacataaattatatgagattcggattttagtgtccataaatatagtcttattggaacacagccacacccatttgtttacatattgttaatggctgctttttattgtctatggtgcttcagcagcagagctgactatttaccacaatgactatatgattcacaaagcctacaatttttactacctagtcctttacaaggaaagtttgctaagccctgacctagatgattattaggatccttttctacccccaacatttgatttttgttcatctttgtggaaccatattgactggctatgtaagattcttctcaaagcaaattgaatcaagccaggactctttcactatgttataaaatcgatttaattatgttacaacaatccttctcatttgagaacatacactacctaactaatccatgtctttcaatctgccttcaccttcattctgaatggcgtttggtatattctactttgttatgttgaacatttctttttttatagtattttaacggggcagcataaaattgcatggctcctctgcaatgtaagtactttagcacgacagagttatagggttgtaaggaagcttgagatgccatctaatctctcctactccttctggacagaattatacttaaagtaccctggaaaggttttggtttactgtagtctttaaaaatccctccacaagaacatttccaaatactcactttgtagcacatcagctgtcaaatgatttgtaacttgggtgcctatgtctgaccaaaagtatatttagagttgttccattttaaggctttaaaatggtttattaatagggcagtacttccagctactcaaaccttgatttttattccagccctgagtcttaaatctgggcaagcacggcttctcagacatggtatcttctaagggcagtgattaagaggcaggacctgggagactactctgttgttgcatgctctattctcccctccacactgtaaaatcctcgcggataggagcaggatttcttttttttcctaactcccatagcacacacagagtgtattgaagaatgttcagcccaacctctttgcaagcatctttattacaaaagatgaagggagggtggatgtaatcaaatatgtactttatattggaaagcaaccaagcctctctgtgcatgcactaccctcatacaatcgataataaattagcattttatttatactgtataatgccgttcttttcaggagtctgatttggaagccaactactgtttgtgttctccaaagtggtttttgatggagtgctaattatgtttcacctcaagagcaatgctgacgggggaccacaatcgccttattgtagtagatccagctgatgaatctccaaggatagcctcatgctatattctggggggcaagtaaatataaaaatacatttttgatcaagaaaatgataccatttacacaacagtagcaggattcagcctttgtaaaacagctgcatagctgcataactgtgacgtgattttttttttttttagtagagaaaaaaacatggaggaaaatatatatcaactcaggaccctagctgaatctggggtttagtagttcatggtgggggcaggggactatattttcaaataaatctagcctaagtgaatttttgttccagatagaagaccaacttaataaatgagtcctgcgtagagaagtatgtcacatttagcaaaagaagacacgcgcaggtagagccaatcttttcacttgtgcgaacctcattaatcctgtcacataaagttttgcacttgtattttagctcaactcaaggaagcttgatccagatattttttcagtatatttttcaatacaacataataaagattggagaatattttaactccacctttttttctttaaagctttcttggccaggtgtggtggctcatgcctgtaatcccagcactttgggaggccaaggtgggcagatcatctgaggtcaggagttgatgaccagcctggccaacatggtgaaaccctgtctctactaaaaatacaaaaattagccaggcgtggtggcaggcacctgtaatcccagctacttgggaggctaaggcaggagaattacttgaacccgggaggcggaggttgcagtgagctgatatcatgccactgcactccagcctgggcgacagagagagactgggtctcaaaaaaaaaaaggctttctttgggtcaggctgccctttgcaaacaccatttttaccaccaaagtccctgcagctcatatactaggctgagatatatgtatgtatgtatatagtatataaaaatggacgtgctctcacattgctagaggtacatagactctctgcatgacttgggattcagaaagtgtgtaaaattaagtaagatgacaatagcaatccattaattattctacatctaccagagcacacttccatgtttggtcctgtgcttttaaggaaagacctgccttttagtgtcatgagggctctcaggaatggcatcttgatgatcacaacattaaatccaactcctctgtcaggcagctaaagtgttaatttattttgtaattagatctctcaccaaagctcacaggaacctgcatttggatctcatttgattatgtatagacccttttatatatgccatcatattaaaggttcattctatgtggcctgccttatgtgctcagtaaacatttgttgaatgctgaaacaaatcaccctggggttaaaggaaagcgttgagggtcacagaggttgacttgccaaacgttactaagctactatggggctaaggcaggagtgaatagttgctgctttaggcaactccacccacccccgaccccgtttgtgctctttctttttttctaaattgttctagcagtctatgatttggtgtacttctttggttaaaaaaaaaaacacacacgaacaaacaaacaaaaccttaagggtctttaaaaaataataagttatctgttattgaggacttaattttgtgcactacactgtaccaaatgctttatatttattaacctatttctttttaagcaataaatctaaaagcttggtattcttatccccattgaaaaattactttaaataaaaaaaacctctccaatgacttttattatattcacataaagctaatggggccgattaaatgtttattgttaaatatccatgaatcatttcaaatatatatgtatttttataattgtaactcatagataataatacagttgggctacaaaagctatttggaggaagacaacaattctaaatggaatgtgatttgtgtttgtcaagattatgtcagcaatctatgattttagcaatttatttggtccatacgtggatagaaaatatcaagcacagggaaggaaagtataaacatttgttcagcaactactatgtgtcagacatcattgatgtttgccatatttagatgtcacaaggaccctgtgagatcctttaaacattttctgtaattaaagatgaagcaactgagtctcatggaaattgggaaatttgctcaaatactttactttgacccaaaggaaaatgcaagtaaacccataccactggctgaatattgggttttaagggtttatagggagaaatatttttcaaaatgtatctgacttgggtgggtcttgagtctagatagaataaagcactctatcttctgtgacctgggaaaggggtgccgttgggggtgggaggagtcgggatggaaaatcaggtctgtttaggaccaaatttagttcccatttaaaacactgaactgcttccaaagaaattaaactcatgaccttggtctacatgaaatgaagccagataaattaacctgacatacacacttatataagaaatccttgaaaaggaagagctgatgaaaccagggaatcatatttcctgtaagaaaagttggtaaaaataccagtgaggtactttggtgtatcatattataatactatcagtagtataaatgaaacgaacaaaaatggtaaaaaaaaaaaattgatctagaataatgtcatcaacaaagtatgcaaccatttcttttttcttctttccaacttttattttaggttcaaggcatacatgtgcaggttgttatatgggtaaattgcatgttccaggggtttggtgtacaaatattacatatcctattctaagtgctgaaaaactaaagtttttaatgctcctatcagcaaaaagagcaccaagcaaataaacatgtcctaatcatttgccatggtagtagatcattaaaaaaatacatttatcttaattacagaatacatgctaagcagaggttcagaaataaaatttctaatgggaactgacagatcgacaaaaggctaacataatatttgcttcatttgtaacaagtattggttgaagggtccaggtaactcaactagcctcagaataaaggatgtaaaactgaaaaggagattttaaacattcttttttagtagcaaaattacacacatgttttatattaaaaaggtaatgaaagaaaaggtggaattttaaaattacgtgaatttctttgggatgaaagcttctggaggcctagtgactgctgaacatttctagaaaagaagacaggtgaccaaaaagcaaattggaaacaaaagacagaatgtttgaagatgaaggccagaggtaatcgatttcattattatattacatcatgtaaaaaatttcttatttcattttaaacagatacacggccatgatgtagaattagattttcttaaaactccaaagaaaaagaaatagcaatttagaaaagcaaattgtaggataagatatcaaactagttagtcatccagttgcttctaatgtcaagtgttttctactttctggcacacacccttgctattgcttttccatttctccctggtcattctcctcctttagtgtccaactcagacttcagccacccagacaaagtattttcttctcctactcttctgattgtgctgagccactttgctgcctctagccctgccacagcacctgttgaatttgcatttcaggtggccgttgaaattgcatttcagttctgagctctggtggataggaaccaggtgccattgatgtttttcactttttcatatattctcagtgccttcccagttgtttagccttcacctgtcttgcccttctctgaattccagtcccatcagctttctttctgtccccatccttgtcataaagccccatccttgtcataaagccccatcacagcatttgccctatgcctgggctactcttacttctctttgcctaattatttcctgcgtgtccttcacatcccatctcagagaggccttcggtgacctcttcatttagatcaaattgccttgcgttgatagtgttgtgtacctagcattgggcacatttgcaattataaatttgtttattaagattttacggccgggcgtggtggctcacgcctgtaatcccagcactttgggaggcctaggcgggaggatcacgaggtcaggagatcaagaccatcctggctaacacggtgaaaccccctctctactaaaaatacaaaaaattagccgggcgtggtggcgggcgcctgtagtcccagctactcgggaggctgaggcaggagaatggcatgaaccccgggaggcggagcttgcagtgagctgagatcgcgccattgcattccagcctgggcaacagatcgagactctacctcaaaaaaaaaaaaaaaaaaaagattttacacccctaccagactataaatgtaatgggggcatatactatgtccatatttcacttaaggttatatccgtagctcatttcatagggctgtacgtatagtagatggccaataaacatttgtgaaatacattgataatatggggtgtgtaacatttgtacttttgaatctaataaatactcatggtttaagtcaattatcagtggtttatggttcaagatgtttgctcttaatttttcttcactgtatcaaatagagatattgaaatttcacttttaccattttccacatttttttccagttccagtaaaattcagatttagtaaccctttcctacattatttctttccccagttattttaagagcatttcagtagataagctggtaacaggggagaaggaaaagaaactaaagggaaggaaaagatattcctgataaaaaaggtttaactatcttgccaaaatgaggttctaagggaatttgattaaagaagtattaaatatatggacatttgtatatttgatactcaattttcaaagaccttttccctttaataaagtagtcaagtgcttttacatgtgggctgtctgaccccagtaggggcataaaaaggctaagaattctggcttgttggattatggcagttggacatttgaaacctacaattttgatgtgcatccaaaatgccactggctaaagagacccccctctaaccctgtccttgcttgtgctacagctagaagcacacaggtgagagcagaatgaaacacctaagaaatctaaagaattggagtttaggaccagaaaatgaaggttggtgttcgagaggctaactggagattttataatgtctggcactctggggaagagaacccacagtgtaaagtttaaggaagtaaaatgtatctactcctttatattaggcggtagtgtattttgcctgtgtttttgttataatcaacaacattgtgttatgattgatccattttaggtctctcttttgcaagactctctgggttccttggatgatgaaaaggttgttttgtattttcatatgtccagcactgagcaatgtgcttaacacttaatagatgctccagagatatttgctgaatgaattcccatgtcctccaaatttgtcctatcctctctgattagtttatttaattaatttatttatttttgagacggagtctcactctgttgcccaggctggagtgcagaggtgtgatctcggctcactgcaaccttcgcctcctgggttcaagtgattcttgtgcctcagcctcctgagtagctgggactacaggtgcttgccaccacgcctagctaatttttgtgttttagtagaaacggggtttcaccatggtgatcaggctggtcttaaactcctgacctcaaatgatccgcctgccttggcctcccaaagtgctgggattacaggcatgagccaccatgcctggccctccccaattagtttttgtctttttttttttttagtttaatgtattttaatagcaaacttacaggaacagcacagaagacagacaacattcaaaacatgtacttggatgtaggacaactcagtcagaaaagtatagtgaatggatggaatctactgtatgataaaaatgctacaaacaccatttagttgccgtcaataagaaatgtacttgttttgaaaaaatccaaatgccggcattgtccagaaaaatttaacgggtttatttataattattttaaagttgaaccgctgaaacttgttcactgaaacattttaacttgcattaatgctttatgactccacatttatattaaaaattcacacacaaatgaaaatggaaaaactgccaatacctaattactgtcccctatttttccacttgcaatcacatacttaggtacattttgaccccatggaaaaaaattaacgttcagaactaccagtaacaggaagaagagactttttttttttattgagaatgaaatgtttcccatcatagtggattcttaagcacgttctccacgtatgcagcctgctagcttgatgtcttttggcataattgttacacgtttggcatggatagcacacaggttggtgtcttcaaaaaggccaaccagctaggcctcagttgcctcctgcaaagcaccgatagctgcactctggaagcgcagatctgttttaaagtcctgagcaatttcttgcaccaaacgctggacgggaagtttgtgaatcagaagttcagtggacttctgatgactaatttcacgaagtgccacagtaccaggcctgtaacgatgaggtttctccacccctccagtagagggcgcactcttgcaagcggcttttgtagccagttgcttcccgggtgttttaccaccagtcgatttgcgggaagtcagctttgtaggagccatgatatagagacctccttgcttaaccacccttctccttcggctggagctcggcgagctagaggcggcgctggctagaggcgagctagagactggctagctggcgagctagagagcgacggtggcggtggcgcggcggcggctgcgaacacaattgctccaattagttgtaagcatattttttaaaccatgcttacctatgttatactatagttgtgtaaagataatttaaagcattaacaaaggatttaaccatttagtaatcagagaaggaaaaacgtgttagaaaaaaatgaagagattaatctttgtactttagctcaagaaaacctgggtttcttggtaaaaaaaaaaaaaatgtagattcttgggtctaatcctggatctaatgaacaagaattttttggatgatgcccaggaatctgcctttaaaaagtcagttacttttggggaccagtgttttgagatataaatgttaaggagatgggcaggaaaacaaatattcttactagcattgttttatcttgactttttcatgtctgagtgtgggaaaatcactctataacacttcacttgtgataaaccgctccagattccaaagcagaagcagagtgaggatggtgtgtgtgtgtgtgtgtgtgtgtgtgtgtgtgtgtgtgtgtgtgtgtgtgtgttggagttactgggttgccattaaacttaattgactctagttatttctgttttctcatgtcatgcccaggataaataatgagtctcaaaagcattgaaatacttttgacccctaaaaaacaatctattagtgttttgattttataatacatgtaagagttatttgttacacctgtttcttctcttttttatcctccactcttgtcaaaatgtcagtcattaaataataggtattttagataagaattaaatatgtagatatttattcacaaagaccctgcaattttccccaaaatagaaaaagccaacttttgtcttcagtgaaagacagaaagggtaacatatgatatgaattattagatataggatactcaaattcaaatttgtttattataaatttgttattttagaaatgacagctaggacatggaatgactaaaaatatgtacattcaataacacatttagaaatacaggaaattttagaactaggtactttgagaattaagagattaagaagggattattttctatctgcacagttctcagggaatagatatgatgagtgatcctaactatttgagtaaatgtcaactgccagcagacaccaccagcttatatcgaagaaaagtcacaaaaaatatgaagagattcatcacactgggaatggaaaacatcgaataagtcagcaagtccagcaaaagaagaaagtattacaagtataatttaaaaatagttttggcaagaggaggttggggagaaagcagagtaggctataataataattataactcaaagatgggccagacctaaatgtacaccttggcctctttccatcctaaaatgttctatattagcaaaagaggtgttatgatttatactcagctccaagtctagactggtttaggtttcctgtgtttaattctgcttctttcttaacaaaaaaatctagtcatctagatctcaagtgaaatgtgcaattgaaggtataaaaataaaattcaattgaggaaggcaagtttgtccttaaaataaaatttaaaataccagcatttatttttaaaaaactacctaattacatctagtcccatacatatgttcaagattaatatgcaactgatgcatgaaaataaaattcagctgagggtaactactgtctcattaaaaagaaaatagaaaactagcatttctatgaaaacgtctagctaatcatataaaaactcatatacatgtgcattgacaagtaaatgctggtgatatattatttgattgaggtcaatttttattctaaatatttttgcatagtgggaatttgttatgttaaataattttgggattggatctctgagagggcttagtaatatattttatattaaattaatcacagtgaaaaaatctttgaaataggcttgatgtttataattatagtattctgtgtttaaacgtgaaaacattgtctccttttaaaaatggtattaactctaggagacaggatatataatgatcaattctttctaccatgaaactctattaattactaaaagtgttagtatgcaaaatacaatataagttgataagaaaaaccaattcacatttgatacccagtggacaaattagaataaaatattataatgttcaaagaacactctatattccataatgttctctgttaagcctgtgtccttctgagtatggtgagtggcaattctggccttaccttcaaacatctgcttcatgtttaaattaaattatgctacgtgcttgtccctgcataagagtagcaaatactgaaagtacagtgaaagggatagtaaaagacttctaagtaggagaagtattaaaaatattctccagctggtaaggctggaacactgatgatcaagacagttctgttgaagggtgggaggcgccctcttctttgctccttcaggtgttaaccttttttttttagatggtggttgattgcagggcctggaggagggcttgagtgtggcctgtgtggcctgggtctagagaagctgttatttaccaaccaatttggaaagagtttaactacggtatttaaaactgtggcagctgtatctgaccaaaagttaagcttctgaacttttccccatagatcacagagggcgggcctccagggaaggtttcaagcaggaggctgacttgaggaggtttttgttttagaaagagccttcaggtagcaatgttgaagatgatggattgcatgagtttgagaaaacattcaggaggattggttttaaaacctaagaaaagaattgaggtagtggctagggagcagaagtgaagaaatggatgtgagaactactttggaggaataattttacagagtcagtgacagttttagaattggatagggtgtgagtttgactcccaggattctggcttggaccactgtggaaaatagtaccattacctgggagaggataaagatgtagtggtgtctgttacttgtttgtctggtttgctggctgattggttggctttatttaattaattttctgagaagagccatgtttataagctgcaggcacaactgcaaatacattaatttaaacatataatagtgcggctttctctgtcggacaacaaaaaagaaccagaaaaggaagggggtgaggggctgaataacattccatgatcacctattatactcttttaactaattttggaatcacattcatgccatacagaggatagtactgttgccatttcacagatgagaattctgacttaccaggtttgaatgactggcctactttctcatagtcagaatgtggcagcgtcacaatttaaatccatttctgtccatcttcagggtctcagtctttaactgtatgaaaatacctccaaaatggaaaagagtgaaaaagaatgaaagggaagaaaagaaaagaaaagggaaagaacgaagaaaaaagtatttagagtgaccaaagaagaagaaagcaaattccaattgaaagggaccaagcagagatgctcatccatgagcaggtcttacccccgcctagacaagttcatagtcctccctaaaggtggcaggaagtttacacagaatattagttcctcataggtgtccctagccttcaggtgacctgaacatgcagccagtaagtgaactggtatcagtttatggccaaaccactgctctctagacttctgcttttagagtggtgcttttcaacctgggctgctgcagatcctcacattctttccggtctgtggagtaattgagagtaggctattagaaacttttataggaatctgactgagtactgttgtatctgctggatccagtaattttaaaacgggattgtattttgtatgtctgtttcatttttcaagtcattggcattgcgttttatgaaataatatatctgtgatgaatcagaaacaaaggaacaaaaactggcccttcaccacagataatttgagaagtaagctttagagcatcaaaagaaaaaaagatgatgagaacctgataggtgtttttgtgctcttggtaacagagactttctcttataaatgtgatggtttagtgaactgcctttacatagcgatctattggccccatatacaaatataatcaaatgatttgtgtcatttgaagctacacaatagatgaacctggtttttgtaatttaacaaaaaatccaatttatgtaacatattaaaagaagcattatcaacttgttttctcctcaaaagactgtagctgttaaactccttaattacttcattttcactctcagtgtaacattagcagtttagcacttcaagtacaaaaatgattaatgagcctgagaattcattcgcatacatatcactttgcatcttgacataaccctggagcctgttctctattctagccatagacatacttccctagcaaatatcttattgcatattaaatgcctaatcattgcaaagtatgcataattatagtcatctttcctgtttttttctacgcaaacaaaaaagacaacaaatcaaatgcattcaaatgtaactaacattttaaaccaaagtataaatccatagggagcatcatgatttttgcattgtaactgtccccgaaaattcaattgtgatttgagctgaagtgtcattcatctaaaaatgtatctttaaaatttttttgaacatgaaggaaaagactttcaatttctatatttatatgtatgtgagtactgtgacttgggaaaatatgacgagagtaaagactgcattgtggattcagagaataagattttatttggagttactgtaagaaatatctgcagggggctatttctgtctaaccatccttggcttgcattggtgacatgtgcctacatgtttcttttagctttagtgaatttcttttttgatctcctccaaggtgatcccacagtgctgactttgtccaatcattcccgaggcttaatcttttaagtatgatcaatggttctttgtgtctttgccttcccttgttttttctactgtattctgtggagttcagccacagctctgtgctgtccctacctaataatcctcttttccctacatgctgatcacctctaagctacactctactacattcagtatggaatcaggaagactaaatgaactttttctcagaactcagagaactgcacttgtcaggcttgttgccattacacaacattgtagttactggaaggtgaaccaaacaacttccaggggcctttcatgtgcaagggaagagcagaactgtagactacttgctagactctaaatctggtctccaattgtttttgttcatgtaggtaaagctatatgctctaaatttgtacctgtttccatttgcttttagagggagacatttagttcggggacaaaataaataatgtccattgaactggacatagtcaaatatttccaataaatttttaaaaccatgtgtgtactccggtaaagcacaggtatcattttctcactgcacaagtgtatactacaaatgcagtcttgcggctggacatctctgaccaacaactagaccactgaaattgcaaggcaatgcagtcaactaaggcactgaggcactgttcccaggaaagatcgtttgattatgatacaatcaggactccttatctagacccatacttgataaatagggttggcagataagttacaggacgcccagatataaaaacaaggaatttaaaaaagtgtaagtatgtcccaaatattacatgaaatatatttatattaaaataaaattactccttatctgaaatacaaattacactgggtgtcctgtatttttatttactaaatatggcagttctatttataagtggtactttttttttgtttgtttgtttttgagacagagtcttgccctgtcacccaggctggagtgcagtggtgtgatcttggctcactgcaacctccacctcccaggttcgaacaattctcatgccttagcctcctgtggaactgggattacaggcatgcaccaccatgcctggctaatttttgtattttcagtagagacagggtttcaccatgttggccaggctggtctcgaactcctgacctcaggtgatccacctgcctaagcctcccacagtgctgggattacaagcgtgagccaccatgcccggctataagtggtactttataagcagcaaagatcatttgaaacagtacacttcctgaggttagtgactaatgagattattcctatatccctaaatgtcatagaagtgggaggaaatgtgaaaaaacagagactcaagagtgggtgtcagctatggagcacgcacgcgcactctggtgcttgcccacgctgcactggcctacactggcccacgcaggcccacacagacccacacaggatcactcagaccgacactctccaggttagagcacttatccagtggatggttcagctttctggaggataggtggagcgttcttaatgccagcccttttctggtccccactaggctgtggtaccctcagaagtcggaaggcgatgttacatactaaggattgcttcctttgtgctgctgcaggatgcccggtgaaaaaaatctgtaaaatgacatccaaataacccaacccttacctgtgtggattttgaacttgctaaaagacacagtggaccccacctatttgtggattgagctaataaaaataatttaacaaacaatgtgataaatatgatggatatgggaaagctgatagtgaagatctttgggtcttataagactgtcaaagaggatatccaagaagaaacgggacaaagaagaaagatgaattgcatttctaagaaggtatttaaatccagtacctccaaaatattaatataaagataaatgcattactaggcggtttttgaataaattttttttgtttacaaactaaactattattctgtaagtaggactatattaaagtgaaaaagagtagcaaagtatgaatgaatacacaaacacacataaaactttctaattagaacaaaaaaaccatatttcttttggtccttttgctttgtttgtttaaggtacataattgaaaaatcagctattctgaatgaaagctttctatcaagtagatgatacttagatttatttttgctgtcacctggcttagttggctatataaacataacaaattgctaattgatattagtaaatatacagtatttgtgacttccttcagtcattatacctttcctcgagaaagtagacttaattgcaccacgtattgggggctgaattttactagtactactaatttatccagcagtggctttctatttgctatatattaacaatttgcatcttgaattagacagttttcttgtagtgtggagatatttattacttctaatgacatgtcaattctactttacttttaggcctaattttaaattcacttaagaaaaccattttttattgaagagatgtgtacatattttcaggatggtcatttaaaaaaaattccaagcaagtgaatgaaatcattcttgggctgtgaattaccttaaaaaatacatttgggaaatatacagtgcctactacccaagatagttatggtgactaattagcttcttacctagatttacagcaccgttaccctgtaaaataatctttgtaaaataggtcacaaactgggtctgcctgaatcttaagtataaatttcatgtttcatggttttgtactgcagctctaaagtaaaacaaaacttattgtcaatcgaatcactttggaggttcatgttgcctcgcatgtcttttgcttaaattcttgtctacagctgcctgcctgatttggatcttgtgccctaatcctagtaactggactcctgttttgctactgtgaacacatttttgtctgttcgcctcatgctagtaactccctttctcattcttccacatgtctggttctgaacacccttctgatgactacagctctgatccctcctctcctggtgaatgatgttctgaacctgtcttaggctgttgtataacaaagtgccatagactggatggtttgtaaacaacagaaacttatttctcccagttatgtaggcttgaagttagagaacaggatgctagcatggtggggttctggtgagaaccctcttcttgtctgcagaatgctatcttcttatatcctcacatggtggagagcagagagcaagttctctggggtctcttttgtaagggcactaatcccattcatgagggttctacccttatgtcctaattacctcccaaaggccccaccctctaataccatcacattctggattcagatttcatcatatgaattttagagggacacaaacattcagtccatagcagatcacagccttcagcggtggcagccttagaatttctatgtagcaattaggcggtgcttggagctgagctgtttgggtatgggagaaaagcagcttgttttaaagccatgtgtgcattgcaattaccctttttttagtaaaagttgcatatttagttgtggtggcttgggggtagtaataaaaattcatgaaggagcaggtttctttgtagccaatcataggcaatgccactgaattcaaggctgggaatccaaaagaattgttttttttttcttttttgagacggagtctcaccctgtcgcccaggctggagtgcaatggcgtgatgtcggctctctgcaacctctgcctcctgggttcaagtgattctcctgcctcagcctccagagtagctggtattacaggcacacaccaccatacccggctaattttttgtatctttagtagagacagggttacgccgtgttggccaggcttgtctcgaactcctgacctctgcatccgcccacctcggcctcccgaagtgctcgggctataggcgtgagccaccgcacccggccaagaattgttttcttacttagttttgtgtctgcagctttgtatataaatagcatatagctgtagtaaataaatatctttgatgattgatctaatgtcatgaatttctagtcctggattccaaatagccacatctattcaactgtaactcttgggataccctatttctcctccttgaagttttctgttggaaaacgcttgctttagccactgtctatggcctctcatgatatcctccagttatgaaggtgtttaatgtactgtgagccatggatagcataatatagtcatgagatttatcataaaacagacctggaactgaatttgtgtcataccaatggtctggttacttctctttgcctgttttacatttcaataaaataaggataataataatattcattctttctcacagtggttaagaggattaaattaggaaacttaagtgtttgacacgtatttgataatcaggaaaattgccctcatctgatatgttgaacttataaaaattgccctcatctgatatgttgaacaaagatggactttgttcaacatactttatccgtgttttagataaatatagatattcaaagtgctgagtcattcattcaacaaactgtctcttaggtgctactttatttcaggctctttgctaagatgaactggaccagaaatttatcagaaaaagtaacagggcatatgacatattagagttaaggatggctagaagagaaatggggatggttcaggtagaacaacacaattaaaaatgtagccccaaggccgggcgcagtggctcacacctgtaatctcagcactttgggaagctgaggcgggtggatcacttgatgtcaggagttcaagaccagactggccaacatggtgaaaccgtgtttctactaaaaataaaaaaactagccccttgtggtggcgcatgcctgtaatcccggctactcaggaagctgaggcaggagaatcgcttgaaccaggaggcagaggttgcagtgaacggagattgcactactgcactccagcctgggtgacagagtgagaggctctatctcaaaaaatattatatatatatatataacttatatatataaattatttatataatttataatataatataattttatatataaattatatataattatatcatttataatataatttataattatatcatatcatatataatttatatatataatcatatataaattgtatatatatatatcccctccaaaattgaagagaatggagaaataataacaattcgagttaatttcggtgatcttggagacattgctgaggctggaaaggatagaactttaagagacttgtagttatgtggactttatggataaatacaaaagttttctcaggcaaatgtagagaatctctgctttgtttccactgactttaagtatatcaccatgataaacactttggtgctattctaattgcatataaacatgcacaactcccatcctgaaggtaggatgaccaattatcccatttgcccaagcctgaggactttcccaagaaacaggactttctttgctaaagctgggagtgtcctaggcaaactgggacaagttggtcacccgctttaaagcaaagacaagactgtgtcttaatctttatgcatcccagaactttgtgtaattccttgtatagtgctttggaggggatcaatacatacttttgctgactcatcagttttaaaccagacccttgtgattttgtctggatagttaaccagaatagacgttggttgaggctgataaattagggaaaatagagctgtttggctaaaagtaaaactaagaagaagaaagccagcctcatctgcaatattgaaaaaaatatgtgttctttctctagtctgcacctgtaattttatgtttcaggtttatttggactctcagaattttcacaatatagcagaattgttccttgcactcagttaaggagtaatgcaatcagaacaggggttggaatggtaataaccaaattcctgccacagctctaccaccctctaataatataaacttaagtaagtcacttaaactctcaaagcattattgctttcaaccaaaggcatgtgtataataacaacttccttataagaaacagctccatatgataacttttataaaatagacttaggaacttcaaaggatgagataaattcgaattattctaatgaccagtcatgccataatgatagtgatatgctgatttaaatgattcagattatggttgtcaacatgtgatagtgaaaataactaaactaccaaagttgaatttccatgtacacactgaaaggacaatatctataaatatctatagcacacctcaatggtcacaatttccagtgagtaacattgattaagtaaaattaaattcttctgaagtttaagtctgtagtctcctaaaatgcccacactggctcaattattcatgaattacagttatattctttttctcaagtctttcaaaaggactaatttaaaaaccagaaaaggtattaacaaatcaaaagaacaaagggacatgttcatttcaagttatgccttgaaattgtaatgaaaacttaatctcaagggccccacatattttctaactgctaaatggaatatcctagttgtacttttgtatctagactgaacaaaacttataaaattcattccaacacacttgccagctaatggatctgagtacatttaatagtaaaaataatgctactgattacattcagtaatgcattttgttttttgcatttttttctattccgaagattgactgagttagtagtccaatgctgatgtgttacttatcagctatgatgaaattactagagtttttcccagttagctatgatgtctaccaagaaactatgatgacaaagaagtctggatttctagtccagctgggcagcacaataataagaatcattcaggagcgctgtatggactgaatttattgagcaagaagaaaactgcatgaacaaactgtggaagcttaacacatctggttagcaaagaaatttattttggccggagagattaaaaacctctttttccagtaacttattctgccagaggtactagaccagaatctgggccatcccacagatcttagcatatgggcatttttcagtagaaggagcattgaagttactgaactgttttctctgcctagccaatttaatatgaaatatgattgaaaccagtaggtccgcactggtatttatttatttcccagtgctttcctaaacgagttttatagtattcagagcatagtgttaaattgattcacctttctccatgtgagaattgtaagcaatttgattagcttttctctattttcatcttctgacatatactgttataactaagaaaaattataacccttttttcttactgaaaataatttatattcagtagtgtttttgtgcctgcacagaatataatctctacaggcttaaatatcaacatttgtaactgtatgggtatgatggtattaagaacaattccaaagacaaattacacttttaaatgttcatgatactgaatttatccctcagaccttataattgaacgttgcaaaccagacacattcctgtgtgttttatttagtgaaggaaggaaagaatgttaaaaaaaaaataaaattagggttttttatatgactgctaaacatgataaattaagggagtcttgttaccctgagagatgtaactttattgatctctcagttaaaagctgctaaatgagtgaatgaaaagatagaagctgggggagggggactgctatctttgctcttcaagaaatggtttatgctaaaatttaatgaccacctactaagagcagtgatgcatgcggaggcttgggtcctttttttcttcctttccatgcctttcacagcggagtctaccactgctgctcatccttagtttcacctgccttactttctgtccagttttcttcctggatcagggccctggcaccctatctaacttctattaattctgtttcctggctgtgggtcatgttcctcatatctaccacctgctttctagtggcagtacaacaattacagctacctgccagccccatcaccccacttgaaaggaatccattatttccagggtcctgcttggattgccttatttcaatcctttaaaaaaaatattcattcttgtgggcttttgactttctcatttccaaggtcttctttttttaacctttaaattcaggggtacaagtgcaggtttgttacataggtgaacttgtgtcatagaagtttgttgtacagattatttcctcacccaggtattaagcctagaacccagtaattatttttcctgatcctctccctcctcccaccctccaccttctgaaatgccccagtgtgtgttgttcccttctatgtgttcatgtgttctcatcatttagctcccactaatacgtgagaacatgtggtatttggttttctgttcctgtgttagtttgctaaggataatggcctcctgctccatccatgtccctgcaaagcatggtactggtacaaaaacagacacatagaccaatggaacagaatagaggacccggaaataaggctgcacagctacatctatgtgatctttgacaaacctgacaaaaacaagcaatggaaaaaggattatctattcaatgaatggtgctgggataactggctagccacatgcagaagattgaaactggaccccttccttacaccatatacaaaagttaactcaaaatggattaaagacttaagtgtaaaacccaaaactataaaaaccctggaagacaacctaggcagtaccattcaggacataggcacgggcaaagatttcataatgaagacaccaaaagtaattgcaactaaagcaaaaattgacaaatgggatctaattaaactaaagtcttcccttaaaaggtcactactttccaggtgggtagcacattcagtggctaatatcttagtttgaagggcatttccctggccagtgtcctctggagttagaaagagctgagcagcatggcagcactggtcctctgaaaggggaaaacatggagtgggatgtgattaactgagatataaaatctcggagggtgtgatccatgacccttgttgacccatgtcttcctcacacctaggagtgcctgcaacaatgtagatcctcagtgttgaatatatgaatgtgtaaatgaaggtacctatttcacaaatcgtctaggattgacatcaccctaaggatggatgttgtttatttcaccagcagtttgggattgtgaaagccctgtgtatggtcacaggctttgaaatgtgtgatgaatctgcatctttaattgggtctctatagtcaaatgagagtcttcatttttctaaaggttcatactgagaagcacaggctttctttcagtgtattgaaggtgcattgtattagattaacactgaaccaaaccattgtcctttgaattgcatgttgtaatcaaacaatgcgattgttttgttaaatactttaaaaattgtattgacttctcaaactaaatagaaacttacttagcttaatagtcagcttatatcatattttatctcatcacatttttcttttctaatgactgtatttgctttattattctgtggctaagtaagatttaaaaaaaaaacccaaaacaacattaaaatgctcccttttgaccaaggtacttccttctcattgtggaaaatgtggaaaactctcacatcaattgcaccaccaccccccttccctatgcactcaatgaaacaatttaaattaagtatctattttgtgtcagctatggagatagactttggggaaataccgttccttttttcattcttcattttgtgccaacaaaatattttgagggaggaatatttttatatcaattattttcattatctaagttaaaataggtacaatggccatttaccctagatttgttttaactgtcctaattttcaaatagtctgaattatttacctgcatttaaagctatgagtcctaatgttggttttggaacatatggtcctcttggagatatatttattttcagagaaactacctgagaatttttacgttttttcttgagtcaaagtagacttatgttttaatagcttgaatagaagaaaatttcaaaactcttagcccattgtaaagttaaagagtacataagtttatgtagtattcatgatttacgaataattggatttttagatcaaaattaactaattgaacttgaaaaatatccaactctatttttatgtcatgtattcaatgcatacacattttatatacccaaatctctagacactgtgcctggcaatatgaatttaaaataataagtaaatatttcttgattttagttttaatgcacaataaaacactaagaataaatagcctagttggtgtatatagaaaaatccataagtaatgattcaaaattatttgaagatggacatattatttttagtagtgagtatatatgggatgtggctgaaattactagacatataaccataatattatgtgaccatttggtgtagataatgcctgactgacaatagcagcaatgtatggttgttttttggtgtttctaccttttagacttacacattttaaatgcttaagatgagtaatctcattcatctttcctgttgcttgcactgaatatttgttgctgctaatccttcttatttccatagtattgttcaaaggtacattccagggcatctttgaagcatattttttaacccccgctgtgtctctaacttgtcatgtaatggttgcttgagcatgtcagccattctgtgtgtgtttgccaagccccagtgtgctggtataagtaggcattgcaattaggctgagagacaagctgcattacaagaactatttgctgcttatattgtcccaatattttaacccaagccaatacagatagcattgagcataatactttacatatagtattaaatatagcatacattacataaagcataatacaatatatataacattgcgcataatatattgagcatgtaccatatgtccagcttttgctaactactgtggagaaatatgggggtgggatgaggaaggcagtattggatgggaggctggtaagaagtataaaggagacctgctcttagtaaactgcagttttgttgaggataacagtgatatacaaaaataattagaaatcatataaggaaaatatacaaacagcgatgcttaggttgtgctgatttaactctttatgatgcagaacatgtaactgggcagctccaagtcctaaagtcttgtaggagttcagttgtttggggtaactacatttcattcatgagttgtatgagtgtagctatcttcgtgtcatgtcttactaccttttgaatcattggtaatcattgttaaacacaatactttggtagaagagatcagtgacaattcacctctatgattgttaatgaaaacgtttgactactgaaataccttcagtggtaatagcttcactattcttaatttttttttaccacaacacttaatttttaatctacgatatgatcattttattgctccatcctctaaatttagccactgagatgattttaaagcatccttaaattccttaagaaaatttaaaaatcaggaatagacagaaggaaggattcacatctatatttatcccaatatactttcctggtgttttggaggatgtcagcttcatcacagattaaacaccaagaaaaggagaggtttaaaagttcacatggatgtgctgcactatgcaatatttttttattttctgtgtgcatattagtaacacttattttatggctgggtgtggtggctcacgcctgtaatcccagcactttgggaggctgaggctggtggatcacctgaggtcaggagtttgagaccagcctggccaacgtggcgaaaccccgtctctactaaaaatacaaaagttaactgggcatggtggcgctcgcctatcctctcagctactcgggaggctgaggcaggagaatcgcttgaaccagggaggcagaggttgcagtgagtcaagattgcaccactgcactccagcctgggtgacagcctgagagtctgactgaaaaaaaaaaaaaccaacaaaacaaaacccgctttctttaggattttgccttttcttgaggacttatattgtttttgaggattttactagcattttctaggtctaaggactcaaaaatcctgaccccaattctttttctcttatacgtagtgacagactgatattattgtaccaattatataactcagcttctcatcattttgatgtgcagaggttagttaatttttagaagctacacagctaataaatagtgtatttattttttacaaaggaaagttctaccttataaaagaatagttctgttatgaaatcttatacatcagttatagaggggaggacatataaattatattacttatacaagtcaactaattttattgtatgataatgagacagatatgttattaaaatttcttcattacatcagtttttccaaaatagacagttttattgacttttctttttctaaaggtattatgaatattatctttaatgccagcatttaaagatctttatgttttgtgtgcatattatagttttttctgtgtgtttgtgtgttatataagaaggatcatgtgatatatacagttttgaaactggcttcaactccccctttcacagtatgtcatagacatctatcagtgtagtcattgattacaaatctgcatcatgattataatgactgtgtagcagcatattgaattgattcgtatgtctttgtttatttgcttaaccaatctcttattggtggacacttggttttcacattttctctctgataccaacacaactctgagatgtgtatactttctatgagactgtgtgtgtcatgcatactttcaaagatagccttctgataccttttttttttttgagacggagtctcactgtgtcacccaggctggagtgcagtggggtgattttggctcactgtatcctctgcctcctggattcaagtgattctcctgcctcagcctcctgaatagcggggattacaggcatgtaccacgaagcccaactaatttttgtatttttagtagagatggggtttccctgtattggccaggctggtctcgaactcctgacctcaggtgatctgcctctcttagcctcccaaagtgttgggattatagatgtaagccaccacacccagcctgattacttcttcaggataaatttcaggaagttgcagagcaatgtcatgttgcagcctctaccacctccttcttttcctcctccttccatttttttttgttatctgtaactatctcaagtctgactgctcgccagtcagaggccaaaaacatgagaagtgagatatggtgaaaggaaagcaactttattgattgaatgctagcagatgggagatggccaggcttctgcctcaaataagccatcttagttttttgggccggatgaaggagtttgagagggaaaaggtgtgggaagtatgctagagtggtgcaggaggttgcaagtctatgttttattccgatggctatcaagtaatcgcccgttggaagatccggtttgcatcaccttgactttggctcggtagtggtggactatctgtatctgtaattcctcctaagcaggaggattctgcctctgggtctctctctgcctgatttgtttaaaaattggcccctggaattttaaggcaagcacataattacataagcgagcactgttcactgaaatgcctggtgggaaaggaggaaacagagtttcaaagtatgtttcaaggctgaaagcaagaaaggaaaaaagttttaaaatgcattttgaggctgaaatacttggttacctgcttatttatatttataaattggtattctaaagtcccaatagaccatagagagaaaaatagagagaaggaaagtttcttttttctaatactctgctgtatgttaggtactgtaaatatagtatttaatcttcatgttaaccctgaaagctgagtggagagtttaaataatatgccaaaggctacattatcaatgtcaaggctaaaagggaatttattaatagttctgtctaatcgtagaacattgttttaaaatttaagtgaaattcatataacatacaattgaccatttaaaaatgtgcaattcaatgtgtgtttccttgtcttggctattgtgaataatgctgcaatgaacatgggagtgcaggtatcttttccagaaccaaatttcatttcctttcaatatatgcccagaagtgggatggctggatcatatggtagttttatttgtagtttttttgaggaatctccatactgttttccataatggctgtgctaattcacattcccaacaacagtgtgcaagggtccccttttctccacatcctctccaacacttgatatgttttgtctttttaataatagctattctaacaagtgtgaggtgatatctcattgtgattttgatttgcattttccccataattagcgatgttgagcaacttttcatattatctgttggccagatatgtcttatttgtatgtcttctttagagaaatatctattcagatcctttgcccatttttattcgggttttttttccattatttcgttttcattattgtatgagttcctcatatattttggatattaaccacttattagttatatagtttgcacatattttctcccacttcgtaagttttgtttttgtttttattttttttactttgttaattgtttgctgtgtagaagctttttagcttgatgtaatctcacttgtccttgattttgttgcttgagctcttggtgtcattacaaaaaagtcattggcaggagcaatatcaagaaacttctcctctgttttcttttaatagttataaggtttcaggtcttacatttaaatatttaaccactttgaactgatttttgaatgtggtgtgaaataaaagcacagttttattattctgcacatagatatccagttttcttaactccatttattaaagagactatcttttccccattttattttctgggcatctttgttaagcatcagttgaccataaatgtgtggatttatttctgggctattttgttctattggtttctatgcctgtttttatgccatcgccatactgttttcattgctgtagctttgtaatacattattttgaaaccaggaagtatgatgccttcagttttaatcttcttgctcaagattgcttcagctatttggagtctttgtggttctatatgaattttaagaatttttacatttctgtaaagaatgccattaggatttagatagggattgcattcagtgtatagatcatagatcattttgggtagtgtgaatattttaacaatactaatttttctaatcaatgaacacaggacatcatttctttcatctgtattttcttttattttcctaatcaatgttttaaattttcagtggaaaaatctttcatatttttagctaaatttattccctagtattttattctttttattgctagtgtaaataggatttttttccttgatttcctttctggatagtttgttgtcagtagatagaaatgacagtgatttttgtatgctaattttgtatcttgcaactttactgaatttgttcattattctaacagtttttttgttgccattagtgttttttacacatatgatcatgtcatctacaaacagggatagttttacttcttcctctctgatttcagtgccttttatttcttgtcttattgctctggctaggacttcttatactgtgttgaagagaagtggtaagcatgggtaccctagctttatatcagatcttagcagaaaagctttcagcttttccccattgattatgatattagctgtggagttttcatatgttgtctttattatgttgaagtcagttccttctatacctattttgttgagaggtttttcttaaatcatgaatggatgttaaattttgtcatatgctttttgtttttgcatctattgagatgatcatgtagttttatcttagagtctgttaatgtggtatatcacattgatcgatatgttgaatcatccttgaatctaagggataaatcccccttgatcattgtgtataatccttttaatatgttattaaatttagttttctgatattttgtggaggatttttgcattgtctgtagttttcttgtagtggctttgtctagctttgatattggagtgatattggcctcataaagttatttctgttttttgaaagggtttgagaaggattggtattaatatttctttgaatgtttggtagaattcacctgtgaaggcatctgcttctgggcttttctgttgttgttggaaggtttttgattactgattgaatctccttatttgttattggtcttttcaggctttctttttattctcaattccttcttgttaggttgtaggtattcaagaatttatttatgttctctaggttatctagttttttgacatataattcttcataatagtcctgtatgatccttttatttttgaggttcccattgcaatgtctcattttttcatttctggacaaatggataaagaaattgtggtgtctatatacaattagatattattcagcctttaaaaagaaggaaacccattttcaaaaacataaatgaacctagaggaaattatgctaagggaaataagccagatactcatcattgctgaatgatctcatttatatgtgagatctaaaataggcaaacttctagaacaagagagtagaatgttgtttgtcagggttggggggaaagaggaattggagagatgttgttcaaagggtacaatgttttaattatgcaagattaataatttcttgagatgggatctaatgtacagcaaggtaactacaatgaaagatacttggaatttgttaagagggtagaccttaagtgctctcgccacaaaaaggaaaataaagaaaatggtaactatgtgaggtgatgaatatgttacttaacttgattttggcagtcatttaagaatgtatacatatatcaaaacatcaaggtgaataccttaaatgtatacaatttgtttttgtcgagtatccctcaataaaatggaaaaaaaatcctaaactattcagcggccttgaatacatttgtagtgttgtgcaaccatcacctctgtttagtaccaagacattcttgttacaccaatatcaagccccacatgtattaaatgagtcttcatttccctcttgctagcctctgacagccatgaatctgctttccgtctctatggttttacttattctacatgtgtcatataaatggaatcatacaatacgtgacttttcgtgtctggcttctttcaccaaacaggtttttgagattcatttatgttgtagcatgtatcagtcctttcttatttttatggctgaataatattacatcatatagatataccacatttgtttattcattcatctgttgatatatatattcattgtttccactttttggctattgggaatagtgctgctctgaagattaatgtataagtacctattttcaattctgtttttttttgttattgtttttgtttgtttttttgttttttgtttttgaaatggagtctcattctgtcgcccaggctgaagtgcagtggcatgacctcggctcactgcaacctccacctcccgggttcaagcgattcttctgcctcagccacccaagtagccaggatgacaggcgtgcaccaccacacgcagctaatttttttatatttttggtagagacagggtttcaccatgttgaccaggctggtcctcccaaagtgctgggagtacaggcatgagctaccatgcccggcccctgttcacaattctttaggtatataactaagattggaattgctgggtcatcttatccatagaacttgtgtagccttctttcacaaggctgtgggtattgtctgataatataatattttcttactatttacaaaatagaaaattcaagttattttaaaagatttgaataatcacaaattttattattgatatgaactttgatgtttagaaatctaaaatcttaatcctctagtacgtttcttcctggaatttgagactcctgttaaaactgttacaagttaaagttgaagaaagcacaaatatactttctagctcctggctattgatatatgcgatttagctgacccatttcattcaaggtcaggagtgttagtgatcttatccagagaaaccacagattcttataaattccctagtttacaattggggatgacaaatcacattttttcgaatcttgaagctgaggatgggctttaaaggaatcatcatgatgagaacatttttacatataattgcccaggaaactattctctagggatcttgagttcatattggattcctatataatttcttcctgtgtattttgagacctgcaagatagaactaaggggaaattagagtgggcaagagaagttcccttcttattgccagtgaagtatagcagctgacatggcttgtcagggtaagtgagtctcattatccctcagtagttgctaccaggtgagctagcacaaggaattaccttcttcctgaagcataaaatacaacagagaggaaatatctcttttttttttccaagaaggggaaaggtaggaaagatgggaaaaaagaaagaaagaagatagtgtacttaattataatatttttgaaatggaggagacctgaggaatcactttagttcaacttctttactttaaatagaaagagactggtttaaagttacccagccctgtggttataaccccgcgggctagaagccaactgtgcactctcctgtggcttgtgttactagtttcctatggctgctgtaacaaattattacatacttagtggcttaaacaacacaaatttattattttactcttctggaagtgagaagtctgacataggtctcaccgggctaaaatcaaggtattggtagggttgcattattttctggaggctctagttaagaattattttctttccttttctagcttctagcagctgcctgcattctttggcttctggggcccttctgtcttcaaagccagcagtcacatcagtctgacctctccgttcatcatctttgactctgactcttctgcttctctctttcacttttaaggattcttgtgggcccacccaaagaccacaggatgatttccctaactcaagatccttaacgtaatcacatctgcacattctcttttgccatgtaaggttacatgtccacagtttccagggatttggacatggacatctttggaggacattgttctgtttaccatagcttgaccactcgttctttaaggaaaaacataaagaaagaaacaaattatataccccctcttctgaggactttgtagatttatttattgacaagtattttcactcatttaaagatggcaccttatatttgttatatttacaaactgcttttgcatatgctatttcatttcattgttgcccttttcacagtggcaacaaagactcaaaaacttaagtgaattttcagaacaaatagtggtcttggcatatgaatcccatgtatttgagtctgtctagtgtttacaacattctactcactatctcatgaaagtgattttcagcactttctaacttaattccttgagactttggatgtcatatgtgggttggtttgtggacattcttcatcatgtttaacatcctcgaagcctctcctacaaagaatgcactgctccttctggatttatgttgtaaaatatgttctaaaactaacttgaattcctatactttcttgcctattttctattcagaaaaaaacaagggaactgatatatttgtctacataattgtgagttgttagaagccaaataatcagtgtgaatggtatgccatgctctatgaatggttgttcagcagtccataaatttggtcttcttcttgagggtaggagtagtgttttgtttactttatggttcttagctattaactaagtaccttgcatttcatagggctttagtaaatttgtgatgtttttaattattgaatgctgattatatcttaagcttagaaaagaagtgaaacttgtggttttaatttaatttttaaattaatctcacattgataagtgtaactattaactacgttataaccttaaaatgagtcatttcatgagtctccaaaggctctttccttgtgtctaaaatgagcaacaaaacaaaccaaaataaaaccacagataatggcagagcttttaactttgggagactgaagaattgatgggagtaaagaaatttacaatttaaaatatcaaactagtttaaccttctaccaattaaattatgtactactggaaagcatagcttttaaaatactgtaactagttaacaaaaatcagctacaatgactgaatcaacaatcttctttcccctaattacaacattaactgcttcacttccttggtgaaaccccagctgcctctcagctccacctgaatctggtgaggcccaccatctcaagccatctttatcttttaatattttagtcaaccaaaatcaatctccatgtttcatttagctatttaggctgatacttacatttgtaaatcataacacaattgtgattatacttaacaatactcttttctctgggattttataggtaaagtagtaatttcttaatggttttctaatttatggaaccaggttgagtttaaatacttaaataaattaacttgtaaatttccattgggttgacttttagatgctctctatgaggaaggtgagcaaacaaaaataaactcacatttcatcaattctaagcacatttttaacatctctgaaatcagggtttaatctgatagtataaggtttgtcatcttttagttagcagcattttgttttttctctcttactggtacataggagatgacggtgcatcttttattcattggtttgccccttagatttcatgaaatgtggtcatttaggtgactctaagcaggaatcttttgcattctgatttgcataatacttttttaggaatgattacaaagcaggctttagaacttctcccttctcaagattttcttcattgatgtatttttctgaagtatggctctttaaaataaaattaagctggaaacaaacctgcttatgtgacatagttcaaggactatatttaacagagttgagtagattcagtggcatcttgacactaacagtggtgggaatttctcttctatattctgcattttcttggtgaacttacattatcctaaacaattgattatttgaactgaagtgaccaaattaaatgattctacgtggcctaaattttcttgggatcatgtgttgtgcacatcttgcccactgttttttctatccatatatcaactctgcctgggtcatacatcctcaataagtctataacatattgagttgaattaaacaaaacacatcatcagggattgaagtttttatcccagaagacttctgaaggtatttaaaacataaacaaaattttaaagtgaggataaataattaagggaaccactagaatttgattatcacccacttaattttcatagctttcttctagacccccaaaacagctattttcttctgtctctttcgattttctctagtgatttttctaagcaaggctgaatggaagctaccagtggtcatttgtgattgacacactaaaaatataatgtgaacacttggaaaagaaaatgcccttggacatttggttagctgcatatctcttgtctcagatgacacccatatactctttcactttccagacaacataaaaattaatgctgtttgctatagcagaaaacagtcagaattattttcagcttttaataaacagctcaatagcctcagggaaattgggcatattacttcatttcttggttttcaaatgtatttctatcacttaattatctaatgaaaatggtattatttatttaaaatatttaagaaggtttttgactcagattttctcctcatttttacctctctctattctgccttctgcatcacctgaatggccttgcaaaagacagtaagagatgttgtggacaaatctggagcaattgatgatatacattttgcatttatgtttgtagaatatgaggaagtctgacaaacttaaaacagctattcacaggctgaaatcccactttctcaaaaaataaaatgaatttttggaatggatttttagagcttataaagaaactagtttacttgtatgtttattttaggtaattactgtattaatactcttttaaattttatagtggtgtatttcaaaatgtctctattttgagatgctgagtcaaatatgtttttcattaaaatgaacctctgtgtctgctttccagtataattatttgtctactagctagaataccatattccattttatttttctttcaggattattctcctaatcccccaagaccatccctgttcagcgtatatttagggcaatgataacaataatagtattaaaattttattaggtaagccaatctgctgaattatgaatttaggtcttgttggaaggacactttttctgaatttgtatttctagctttccttatttatttgaatagttgagattttagtatatttttactttatattttgtagaacaacgtgaattttagcatggaccaaaaaattaacgctttattttaccagtgaacaactacttgaagaaaatatggggccgggcgcggtggctcaagcctgtgatcccagcactttgggaggccgaggcgggtggatcacaaggtcaggagatcgaggccatcctggctaacacggtgaaaccccatctcttctaaaaatacaaaaaattagctgggcgtggtggcgggcgcctgtagtcccagctactcggtaggctgaggcaggagaatggcatgaacccgggaggcggagcttgcagtgagcggagattgcaccactgcactccagcctgggcgacagagcgagactccgtctcagaaaaaaaaaaaaaaaataaaataaaatatgggggcagggggtgcgcggtggctcacgcctgtaattccagcactttgggaggctgaggcaggcagatcacctgaggtcaggagttagagaccagcctggccaacatggcgaaacttcgtctctactaaaaatacaaaaattatccaggcgtggtggtacatgctacagtaatcctagctactcaggaggctgaggcacgagaatcacttgaacccaggagttggaggttgcagtgagccgagactgcgtcactgcagtctagcctgggtgacagagagagactctgtctcaaaaaaaaaaaaaaaaaaaagagaaaatataggaaccactctttgttgcagaaactaccctttgtgaagtatctattaggttataatatatcacatttttttttttgagacagggtctcactctgttgtctgggctggagtgcagtgatgtgatcatggctcactgcagccttgacctcccaaggtcctccacttgggaggctcaagtggtcctcctacctcagcctccagagtagctaggactacaggtgtgcaccaccgtgcccagttaattttttagttttgtagaaacaaggtctccctatgttgcccaggctagtagtgttgaactcctggcctcaagtggtcctcccacctctgcctcccaaagcacttggattataggcatgagccactgtgcctgacctacatcatgtatttatttaactagacattaccacttacagagcactttttcattttattctcatcacaattctgtgaattaggcattattatttgaaaacagggaaacagggtttagaggggctctggggcttgtcaaaagcaatcatatttgaactttatcaatactttaatccacattttctgattttatgagtgctgccatttcccttatatcatgctgcttatttggttcgtgcatggaattgttattatcaattaaatataatctctacagaatgaatgataatgaacattatcatgtgacaataacattgtgcagccattcagagggcacttcaaactttggattttcagaggcagtatctccagtaattagctgtctttagaaaaatagcatctataaatgcttcttagtcctgcccataatgagagagttattgacaaagctaggatgtgaaccacgttctagccatgattcatttttaaattaaaatatcattatatatgttagggaagaaaataagggcctttaatcatgaatatgtcctatatagaaccaagataccaattttctcacgtcagttcgctcagtaaatggtaaatttgaatgcatttgccataaagacaagaataagtcctaatatgagaatgaaatttgctgcccccatgttatggtttggctgtgtccccacccaaaatctcaccttgaattgtaataatccccatgggtcatgggtgggaccaggtgaagataattgaatcatgggggtggtttcccccatgctgttctcatgatagtgagttctgatgagatctgatggttttataaggggcttttccctacctttgctctgcatttctctcccctgctgccacatgaagaagtacatgtttgcttccccttctgccatgattgtaagtttcctgaggcctccccagccatgctgaactgtgagtcaattaaacctctttcctttataaattacccagtctcaggtatgtctttattagcagtgtgagaacagactaatataccccattaatttatctcactataaaattatttaaaaatatttttactattgttattttatccacttatgagaactcaaaacgtcctttgaaataaatagggaaatatttccaaaaataaaacattttatttgtagagtttcttttctcaatgctacataatcaagctccacttgaggaccttaataacaatctttatcaaactctaaaaggaatttttatctttcattgctaggcagaatactcacgacttaccctggttgtctgagcagtcattatctagaatgttaccggttactatggcagaaaaaagagagcattagagagtctcccattggtaattaatttttctgtcaaaaaatgccatgttacttccttccacaagtcattatcagaactagtcaatgatgactgtgttccagtcttttgcctgtttactctgaggtcctttcccttcccttttcaaccttgccctggttttcaagaactgcatttcataggcctttttgctctctggattccaggtagttttggccattgggaggtactcatggcagaatgcagagggggtgggggtagtggataaattagattatttcatctccttctttcagccttgggcagtatctctagcagcagtggcttctctgtgatttcacctcccaactgacagcttgatatagttccaacttccacgaatggcttccggggtctgttaatcgtactttctctttgaccttcttcgcctaaagatataaccaactcctaggtggctttccatcctctatttggcctctcagctcttttaacacatgcataaacatttccctgtattaaattctctgtattgaaatgttaatgtggtttatgtttttgaggagctcctaactaataaatccagattaggacattcaatcttatcgtgttcccagaggacacagaactggaaatatttggtgaacagctctcatgattgctgtactgcctatttacatctgacttgcaatctacctctctccagccagacctctactctaaactataggaccgtatatatacatatatccaataaactacctgcttttgaatgtttcagagacacagtaaactcagcatgtcaaggtggcaacacatgctcaatcccccagcaaacctcatcctctcctgctccctccctcatgcattttgttagtcgagacaaacataattaattcttgcaacttcattccctttcagcctgcacaaccataattttaaccataatcataatcataaccataaccataccaataattaaaacccacaacctttacaattatgtaacctgtgataccctgaatatctctcacttctattcacttctctacattccactgctatcaccctattccaagctcctgccttcaactgaatgattgcaataacgtcttaaccttgtactcaatgttatattctcaaaattaaagttaatcatttttaaagacctccaaagattcaaaccttcagtgaacgaaggtcgtgaccttcagtggcttctaattgctcttaggagaaaaacaatactccttaacataatcctagaagacctagcaaaaacttcctcttcagccttatctccctccccacccctgcccctgatatgccatcttactctctgaattctggcctcaccaacttctttaagtcatttataagtgtcagtccttcccaacccccaacataacctcgggcttttaaatatacagttaccattgtctgaaacacttttcttccttactctctatgttaacatcatttagtaaggatttacttcagtgttatagcctcaggaaaaacttgcctgaccaccctgactacataaaataccctgttacacacattcaattgtgtcatgtacctctgccaggaagcattaacagaattgtgattttacatttcttcgtgtgattctttggtgagcagtaatctcctccagtcacaattgtctttaaactctttgaggtgagagacaatggatgattttgctaaccattatatccatagctcctatcagtgtctgggacataactagctcttaataagtatttgataaattaatgaatgagagcactcttcttcttccctcccttcttctatcctgtctttctctctttctttctccctcccttctttccttcctttttcattgtgtatttactattaggaaatgacaggtctggtactgaacagttaatttctacctataatttttaattcctcaccagtactttctttggttgatgtggagagtattcagacagtgtctaagttaattttgtgttgctataaaggcatacctgaggctgggtaatttataaagaaaataggtttatttggctcatgattctgcaggctgtatgagaagcatggcactagtatctgctctgtttctggtgagggcctcaagctgcttcccctcatggctgaaggtgaagaagagctggcatgtgcagagaccacatgatgagagaggaagcaagagacagacagggggaaggagcgaggctctttttaaaaacccccttttttctggaactgacattctcacccaagagccaatccagtctcatgagagctagaacttaccaccatgagaatgacatcaagccatacatgagggatctgcccccatgacggaaacaaacacctcccatcaggctccatctcccaacaacaccacactggagatcaaatttaaatatgagatttagggggacaaacttccaaactatagcagacaaaatatttgtggtcatgggcagcctatcattagcagagagagggtgcagattttcacatcagaaggaataggtttcgagtcctagctttgccacttgcttgttttgcactctgggctattgcaatgatctatctgaactcagtttccttcttggtaacataagaggataatcagtgccagcttgtgggcattacattgtagtaattatatatctaatgaaacaaactcacatgtagaagccactcaataaatagtagtcattttggccgttgtcaaaaaattattaagtaattatagattttaataagaactattaggtagcatagtgtataggaaaacctttactgagtgttcatatgtaatgtttgaatcagacaatgaaacataaataatggataagaaatataacgtacaattttggaggattaaaatgcagttcatttagtaaatactatgtgaaaacaatgtgtgtaggtgcacgactatatatacacacactgcgcctgtttctatttgcctatatattctttttttacctgtatactcttctattaatattatttaaattgacaaatcatacttgtatacctttatggagtacagtgtgatattgtcatgtaggtatacaatgtggaatgatcaaattgaggtaatggataggtccatatatcttaggtgaaagtattgtaatagcacccactgctgtcaatttttttcattaacttttgtgttgtttaaaacactgtgtttcaatacttttttaagtgtttttaattctttagaaagacaattccactggaataccttgatctcttacttcatagaggaaaagtagaggaaagaaaaagcttgtgcctctttactggtacccccaacaatgtctgtctttgtggggtgagaactgatgtcatctttggcagctatatggctgatactgttctgtgagattgcaacatatccagcacatgcctgataggaaacccttttccaaatagtaaacaacccttcacaaggcagctctgccaaagctatgtattgccattcaacagaagatcaacaggacagtccttttctctttactttaaaaagcatatgcctttaatgatgtgttatcgttcaagccatctgcagatgtactgtccatccaaattgccagggttaaattgttgattattagaaattgttgtgattgtctgattatgcttgtgtcataaaatgactattttctgtcacaatttgacgagcccctgctttagaatagcaatacaacacattttacccatttgcaggtatttcaagtattaaattggatgaatctttttaattttcttctactgaattgagttcaagtgaatttgataggattattagagcggctagtgtctggaataacaatgatgacttacagaaggagccagcagggctgatgttattgacgaagagatactttagaccctttatttgtcagcagggagccctgctctgtggttcctctatgagtccttccctgtgtacggtgcccgcctgttttactttgaaggcactaaatgcatcttttcaatcaatattcaattatataagacaaggaatgctggttaagtaaccatgcctatctgtcaaggaaatgcatttctccaaataatttgtcagggcttctgggttagttcatctttcctacctctggttgagtacttgcccagttacacttgtcgaacacgtgctttaccttcctgcacagagtctcctttggtggcgtgtttcttgcttttcttctggaaacacccttctcagctccattccttgcagtatttgactctcgctacccaggaaaccagagaacattcttcctagtttcacttcattttcttgccttctcatataggccactgccaatcagctgcctcatttaaatcctgcagtgtatgtttatattggtcttaccttgtcctttcttcctaaataaacctggggagctttggtcatgttcatttttcaacaaacctgactaggtattctaatttcgtaaattaaccatcattcttgttttattccactggaaattgacttaacatattattcactttggcccaatctgccaggcaggcatgaggatattgctttctaagctaccttctaattgaagaaatatgaagatttcacaggtcaacacataggcagtgtgaactggggagcttttagcatattaattgggctctgaataattcactatagttaatgaaagttgtgcttgttatctaagatatatggagggcactgctgtacctttcgtaggacaattcaaaaaaacaaaataaaacattaatgtaaaatagataagcaatgcataaatgggttgcagctcatattataagagttttgaattcattttatttcattcccatacttctcaaccaatccagctacacccacatcttatttaattgacagatttggactgtcttgctggctaggaggataaaggcaacaaactttctgactgatcctggattttcctcaagagcaagtttccttagttattggtgtgtcctctgggtatcctgcttcctgaattccacctttgatcctcctggttcttaaccatccatgttgtcttcagagtctgcttgtctgctcattcctgttaatttttttttaacttgatcttcaattgtgagtcttctcacttcctgcctgttctaacttgggctcaaccttgaccccagtcttcagctctgcaggtgggagatgtatggaataactgaagtactccacacggtgttcctgcttataacacaaaagccattgtcatttgacaaacagatgataaagaatctattgttattatttttactttttacctcattattactagtattagaaaatgctttactaagcttttgccaaatattagaccgtgtgctgggagttctacgtgtcatatctcttttaagcctcacatcatttacagaggaggcactgagaggctgtgttgcctcccctggccacatacttattaaatgaaggggtaagaatttgaatcctgacagtctgactgcctagcatgtgcctttatatttgatgctgtatcacactaaattaacaccccatagatccattcttaaatacaaaaatctatatcctcagactttcagggtgttaactttgcactgtaagttggagtctttacattttaaacaaatttcttactttctgtttgttttggattgtcattgcttattttttacttaggagtataaaaataagatagtgaaagtttggacaaccttacatacctttatcatcttcagaagtccgatttttaatgatacgttaaaatagtcacatgtaatcattcattctacaaattcagcaactgtttgctgagtatctactgtatactagcaatgatggaaggcactggggatgtaatggtgaacaaaaaggagtctcttcttctatagagtttacacatgtaagctgggcattggcccagccatgaagagtaagaaacaacttatgggaatttgttgagcttcaagttaaactctgttaaaaacaaacaaaccagaaatatatatgtagagtgtttaatgtgttctgtggctctcaataaatgatggcgttgaaaaataaaatgtaggtaatttgatttaatattcaatcagatgcttgcatcaatcagatgcttgcaaacagggtataacaagataatactatgatatttcttggaaggtaatttaaatttcagtttaaatattttattcagcttatttatcgctatgtaattatacataaatatataacttgaatcataatattctagttttacttttcttgcttcctattgggcttctccctctccatccctttccctcttgatgcaaaccagccatcccttgcagtcacccccaacaatatcaaagtgtgtgtactttcatttttcctccctatgttcttatatttctatttaggaattacagccacacacacaaatacagggttttattatgtcttagaaaaatttaattatcaatattggtgtttctgcatcttgcttttattaataacactcaataatgagtcatagataagttgttaattggtataaaaatacagttagaaggaataaattttagcatttgatagagtatggaaattatagttaataatttataatatatttcaaaataggtataagaggaggagcataatgctcccaacacaaagaaaagataaatgtttcaggtgatggatattccaattaacctgatttgatcattacacattgtatacaggtatcaaagtatcacatgtagcccctgacatctgtacaactatgatatgtcaacaaagacatacaaaaatttcacattacttttgtattaaataagtataattttataagtaaaaaaaatagtcattgaatctgtctaactaaacagacatagctctgttttctttttcctaataggtgcctaatattccagctgaagtggcataatttattttgttttaccctatttgccacaggcacattgctcccaggctttggcattacaaatattgctgcagtaaacatccttaaatatatgtccttaaataattgtgtatctgtggaatagattccaaagcatgagcatgattgggtaaagaagatgagtcttaaaattttaaatagatgttgagagattgctttaaaagaagaaaagatgtctcaattttgtttttacaagtatatgcggacatttcacatgttgtagattgatcagttgttgttacttttaatttgcctaatgacttgtacattggacttttttttgataagttgcttggcttttaaattttctcttctgtaaattatccaatttaaatatcctgccagtttttttctattgtactatttattctcttgtcaatttgtaagtatattttatatattgtggatattaaccctatgtgttttctgcatttcaaattatttttcaaatctagcattgccttgaattttttaatgatgttttccataaataaacatttaaagatttttgtatagtaaatttgtctgttttaggcatctaccatcttgtttaagatggattttcttgtctcttagattttatgtcttgttttctagaatttttaaaaacatatgtaatcttttaatatttttaaaaatttgtaagcctttgatagatcaggatttttaaaaacttgatttaaaatagagttactctttaaatttcctccagatggaaggacagttgtgatacaatgatttaaagcataatttatcatgttcccacaaaatttaagattgtttattaaaagtaccccctctttttatagatacaaaaatatcttcatataaatatttgatcaagttgtcattcatacattcaacaaatattaagtacctcctgttttcctggaattctgaaagaagcataggggtgggggaagcacaatcttgaaatggccactgctttttagagatacagcattcaattttgataacagtggtgggtccagaaatctcaaaaggctgaaatctgttgatggctctgtcactaagagtatgacaggtttctgacactcaacagtgctgggttttagtttcatctgaaacaaaatgaggaagttatgtccaatgatctccaaagccttttctagtcctcaaacatgacagcagctgttcaatctcttctactacccagctatttaaagttatcttctgccaaaacaagcaaaagctcatagctgagagagaatgaatgaatacaaataaatgaatatgaatatgtaaattggatagactgaactcagccaatctgaaataaaggtgaaagtgatttggtgatcaagctctatgtcatcttccttctctgaattatggtgatgggacaggggtttgaaaactcactttaatgaaagaggtgaatcactccatggctgaaaacagataacaaattacttgagaaaactggcaccatgacattttgcaggtaattaagcattcaccttccctgagctctcaccttgacccctgaagagatattcaggatttaatcacaatatatacattatgtgtagattaaccaaattttaaaattgccattcttaatttagtagtaatttgttagattattctggttcaaatcacctcaataatatcgactttaattaaaataatcagtataatcacaatgattcattttagtgcttttgttttatataaaaatctgtgaaaactttcttctttttggaagacaatttaaaaaaataggctacctgtcttaatgtatataacaagttaagtgtaaaatcctttacaggtacatattctttgtaatttatgtctagcatagtcatatatttgaaatcgagttagccattgaaatgaaggaagaactttgtcatgcaaagccattgaaacaacatacaaaaataagttgaagtttttataagtgaccattcgtggtcatcttatatgtttgaattaaggaaacaaactgaaatagccaagtagataaaggaagagcttgcctggcatgcaaagctagagaatactacacagaaagaagttcaagcacagaaattacagttcatgggaatgtcagaatacaaattctgtcctcacaatctcttttattcggtgagtttaccagttttaaagcattaatgaaattatttcaggtaattactgttttactcccatttttattgtctggtgtctctttagcacaacccattgaatcattctttcatcttaagtcactattcataaatgcacatgcaacagatggtttatattagatcatgtgatcctttgagccagagaatgaatttctatttgggtttcattcgaaattatctacctcagagataactgaaacctaacttgatagtattccctgtattctatttaatactttaaaagagtatgctttctgtttttctggttgtgtaaaatacaccttgaacacattcagcagactgctatgtacaaagaaagtgttcaataggtgtgtctgctgccgttttaaatttgggtgttagatattctaggtttcatcaaaataaggcattgtttcaagttgtttccacaataagagcatatatgcacaggcaaaacatattttgaaatggataaatggatacatatggatatgggtgatatttcttaatagcgtagctggattgactcaggcagacccttcagccagacgttttctttgaactggatcgtctctcctgtagcagaggactccagccaatgaagttaattagtgccagattaagatggtctcagcaggtggctgcttcagactctctctctcctctgtttgttgaagcctcatcgttggagaagggcttgagtagtcttgtgttactgacagctgtctactgttaatggaccatatgcaatgatggtaaagttgccatcaactgttgatgaaccatatgtaaatggtgaacagagtagcagatgaatacttagaaacaacgaaaggccttcactgctggactgagagtcagaaccttaaaatgattttaagaaaaggttgctaaaactatgtcatgatcattatacctttactgcacacaccctctgtcactcagtttgaggatctaagacagatatgccaatggaaagattattgtcttaggtcttacaaaacctgacatagaaggctataataccccacagagacatgatttttcagtttcattaatgaaaagaaaattaataatagcaaattaatcactaagctcaaccattttgaaaagttaaaagtattatttaagggaacatacgtagaagaaattcattatcaaatgaagagtatgggaggacttttttttgaaaggcagtttgattctacagggatgccctttactttctgttaagagtatgatgttctataagctgagatggggaagaagtagctacttaatttacagagaggtgattaaagattatatacaatgaacatcctcttaaagtaatataataatgataattgccaatataatagctaggtattttggatgtcctactcatttcatccactcatcattcttatgaagcagatactatcattatctttattttatagatgagggaaactgtagcctaaagaaattaagtaacttgctcaagattacgcagctgagggttttaacctcagtctgtctctggaacctctactctttttttttttttaattttactttaagttctgggatacatgtgcaaaacgtgcaggtttgttacataggtatacatgtgccatggtggtttgctgcacctatcaacctgtcatctaggttttaagccccgcatgcattagttatttgtcctgatgctcttcttcccctttgcctcccaccctccgacaggccccagtgtgtgatgttcccctccctgtatccacatgttctcattgttcagttcccacttacgagtgagaacatgcggtgtttgattttctgttcctgtgttagtttgctaagaatgatggtttccagcttcatccatgtccctgcaaaggacatgaactcattcttttttatggctacatagttttccatggtgtatatgtgccacattttctttatccagtctatcattgatgggcattagggttggttccaagtctttgctattgtgagtggtgctgaaataaacatatgcgtgcatgtgtctttatagtagaatgttttataatcctttgggtatatacccagtagtaggattgctgggtcaaatggtatttctggttctggatccttgaggaatctccacattgtcttccacaatggttgaactaatttacactcccaccaacaatgtaaaagcgttcaacctctactcttaagttatgctctaaactgggtacggttagtttaaaggtgaagtgattttgccccatttggaccttatttccaataattggaccagttattcaagtgacatccatggaacatggtatatgtttgctaactcattttttgaggtaagaataactgaataaatgggtaaaatatatgtgtaaggaagctattgttattgcattgttatgccacagggggcagttattttcctgccatgatactgatgagagattaattttactctttgtaaaatgtaagaaattacaagaatactgcaaagctgttttgcaaactccataaagcaacatatgttaagtgtcttgactgcagaagaaagttgttatacacctaaattttattgagtctgattctctgatttccattttagaaataaaatgtgtaaatctaaagacaaaaatcctttatgcaggagttagaaattattactcttggccatcctgcttacagcccatgtaggaagagattcagcacccaaaaacttcctccttacggctttatctgtggcttttaagatcagaaccatgtgtcaaagtctagtgatcttgttacttttctacagaaaagttatacagcagaaaacgtaggagggtaatttaaatgaggttagaaagggaagataattaaagaaaatctaatgatttactaaaatgaaggcataatttacaacatgtattatacatcaaatacctttaggttaataaaataaagcaagacatacttattttcaaataaccattctatactacttctgcctatattataggagttttaccaggctctcgtatctgacagtgaaatgatgctcatggactaaagtcttgtattgagagtttggaggctgtggtgctagatttccttttactatagtaacttgttttgtgatacttgctaagtcacgtaaaaagttgacctttagacattccttctatgtaactggtttagaatccatgacctcaacattttttgttagttatgttgtgtttttaatgctacaaaatgctatgattcagggtcaatgggatcttcaaatatttagttattaactcagcttaagcaaagactgtattcataaattgtatataatattagtagaaatttaaatacaattgtaaaaatgaaaacaattgaaaaatacttaaaacatttattacaaaggtgtttttcaaggttatgatggcacaattacacagattggaagaactataattggcactttcaactttaagaatactttcaatacaactgacaggttttcaaaaggaagaaactccaatacatcaagaaaccattgaccttttcaagtaatcatttccatgctagtgttaacaaaagaaacatttcaaatgcataatctcatcgtgtagtttttagagaactgttgcctaagtcactgttaatgtaaaataaagtcagaatgcttttgacttgatgctgaaatatgttggatttcagcaagtctttaaaaaaatattttcccacttgtattattgatgaaaataagatgatcgtagacacaccattcacccatttagtgacatttcacataattgtttaacatgtttttcctgtatttattgtttccactgttttacttccatgttgtgttttttttttacttgaaatgaagactgtagcttcaaacattcaaaatggaattgagacctaaactattctacctaatggtggaggctcaaagctgattatttgaagtatctgaataatcttctcagttcttatcataataagactgtccaagaatgcagattgacattgatcagttgtgagtctcttccttatgcccaattctcttgcccttgcatcagacaagctaaactttggatacttgtacacaactagtttcagttttggtggttagctttcaggaagttaagaagatagagttcttatgaaagcaagctaggaagtcttactttctacctgtgtggccctgggcaagttacttggcagattttaaggccagtttcctcagtaggcttaatgatattgcctacatcattaagttgatgtgaatatttctggagcgaatccatgtgaaaatggttaatccactgcctcacatttagtaaactattcaataaatgtcagtcattctgatgatatagatgattattgatgatgatgatgatggcagtgaagatgataatttcagagaagattttatctgtgcagttcttgtagtatcattcttaacctctcttgaaaaagcataggttccattgtataattacagattctgggacagaaaattaatggaacaggcttttgtaggggatgtgcagttattttctcaagtccccaaccccctaaagaatatctgatttttaagagatcagagtgataatcaccccaaagttggtcacagtctactagcaaatctcacaatcattgctaaacaattgcaacacctctgtaccactcttttttctgttattagcaaatcacagttctcccattagtgagagcaaacatcaaaatcgccttacatgtctactctaaagcaaagcactttgctgatcttttcaaaagaaaagactgggtgcttctggaatactatcttttgtctactacatgaatacatgtcattaccactagtctttctctaatttttatttttccaggacctcctatcctgcctcccacatttcctacctagcttgctctcttttctgttcatttgagtttccacatgcttcaaagaccttaggctatgagtggtagaggctgtgaagccttacctaatagcaaaagtggggaaatggagtatataattggatatccaaaaccaattattatgatcaattctttgcatgaaataataggcaacactcagatgaaaagtatcctagtatcaaatattccatacatatagattcttgcatgttttaacccttatttatttataccttgagatagctctaagccttctccagtctattaaactatggcaactaatatcacttgtacatttgttttccatcagggaattacatatatctaattataatctcccttttttttcatttttctccaaccttagggaatcatagtttcttttcttttcttttccctctttctattcccaatttcatcacgttccctcagaatagtattacttccacatctgcatatatttttattcattaattcatttaaaacacacaaacacacacacacacacacacacacacacacacacgcatgcacacacacccacagtttcttcatgtatcagaaaactatagtagattttggagatccagaagcaattccaacataaaggtcacttctctcatgaaacttatattcaagcgggtaagtagatcataaggtaaaagcaattgataagccctaacaataaacattacaaggagattaacatcaattatggtgatgtaatggagagtggctagataggcaaggtttttctggggagatcatatttgagcccagacctgaataagaaagcatcagacaaggaaagatatagggaagaaatacaaagtctctctggcagcggcaagttggcaggtttgagttcacacacacacacacacacacacacacacacacacaaaaaaaaaaaaaaaaaactgtgactggagcatgacaggcaagagtaagaatgagacaatactgggatggagaagtagtcataggacagatcatattgggcattggcagtgaacttgcattttgttctaaatataataggaatccattggaaggttgtaagtaggatgtgtgatatggtttgatttgccattttagtttgccactttgactgcttttggaaaatgttttgtagcaagtcatagtgggtatagtgagatgtgtggttggacgttgttacaattcttttggattgttctaagatggtgacattgtaattaaagagaaattgacaaattcaggatatattttggcaacagaggcagtgagactagcagatagtcccattgtttgtaatctaatagaattaccctaattatatttgacaaatctgaccacagtgcctgggacaaatgtgaatcagggattgggaaattaagtactgagtggaaattctaaccataaaaaaagagaaaaaacagtgtagtcaaccttaaaaacatttaaaattgttcataaatccccttcaaaatgtctgcaagactttccatcagacctaccggtgtcttttaaataggcttttctgtaaaaacaaattattcatattttgaaaagaggaattctttttccattcctaaaatacataattagatacaaaataggtaaagaaactagcaacgtgcacatgtgaattaggcaccataatagacgttgtaatataaatatagtgtacattcctcatactcaaggatttcatattccagtggagtggccaacatgtaaacaacaatacaaacatcccaatgcatctcagagggtggatataattgctcatgaaattctgctcaaggatgtctttctagaaaccggtatttatcactgatgactgtaggcacatgaattccaaagaaaaggcccaacatggaccactctatgcgtatatggcatgctgtatatcagaattatccagtagctacaactagtaaaattgtgataaattaataaatgaagtgatgaaagagttgagatgtggcttgctgtgtaggctgcaaaagattctgaaaagcccaggtgctgtggtcaaacgtttttgatgtatttgaacctgtaaagtgccatactgtttttctcagtggctgcatcattttatattgctaccagcaaggcacagggttccaattgctccatgtccttgatgacacttgttattttctattacagtcaagagccacataaggatgtttcagtcaatgacgaaccgcatgtaggatggtggtcccataagattataatgctgtatttttactgtaccttttctatgtttagatacataaatacctaccattgtgttgcaattgcctacagtattcagtacagtaatttgctatgcaggtttgtagcataggagcaataggccataccgtatagcctaagtatgtaataggctgtatcatctaggtttgcataagtacattcaatactgttcacacaatgaaattgtctaaggacatacatttcttttttctttttcttcctttctttctttcttttcttttttttttttgagacagtctcactctgtcacccagactggggtgcagtggtgtgatctcggctcactgcaacctctgcttcgcgggttcaagtgattctcctgcctcagcctcccaagtaactgggattacaggcacacgccaccatgcccagctaattttttgtatttttagtagagatggggttttgccatgttggccaggctggtctcggactcctgacctcaggtgatccacccaccttggcctctgaaagtgctgggattacaggcgtgaaccactgtacccagccattaggacacgtttcttagaacctatccccatcagtaagcaacatgtgccattaagtgacacatgactgtactttgataatagccacccaaatgggcatgaagtatctgttaagtgttttaaattatgtaccagatttgcaaatatggtgtacgtttttgggggccagatgcacaaatgtgaatcaggattgataacacaagtaaaagtgaaaagaaatgactgtcttcataaataattcgctcatctaaaaaatattattgttatgtttgtacaaggcactacgttagcctcaatgtatacattagttagcaaacagaacctgtcaagtccagtgggggattatgggcatttgttaactaactacatgaatatatagtgtggcagatgctcttggtgcccatccacatgcctttggcagtgtaaagcaaaggctgtttacttcgaacgcctgtgaatctctgcctgaggggttttgttcctggtaattacaacatacttggcccacgcaaggggtaagccctccatgctgaggcatttatattcctgggagaagccctcaagcaatgatggatgagaaatggtaaataaatagttcagtttctttgtccctcatttgggatacctctgagatgtgttctatattttctcccagagctccatagcaggattaagctctaattgctcatggtgctaacatacttgtgcaaatagtacatatcatgtagttacctaataagtctgcacatcaaccatatgattgccacataagttagtactccagaaacatctcttacactttaaaggagctcttagaactttttatagggtcgcctaaaatatatagaatatattataccacggactactcttttttcatctattaaagtttcagagggcaaatgcctgaaaatctactttggtggcaatgctgccaaggagaaatggtgacattgctgtgaatgagcttgacccgaatgatgttaactacaatatattgcttcatgtttagtccaaagtcacagagaaggctttttataaaactactaatctgagctgatgactaaaagagaaatatttaaaggtctttcctcctctccattgactcagtataaataggaatgacatgcacatagtgaggggagaatgtggtgccatgaatagagattttgtagcacatttttcattgactttaatgagatgcgtgtggataaatgtgttagtgcggttggcagagtgtcttttttttccaaagcatcaaggtttagcctaatgtctcagtgaatctttgaaatggagctggaattttaaagataacaagtagtgttcagagagcccattgacccagggagcttgcaaggcccctaccagtttcaacagtaatggaaacatttggcaacattgaggaattaaggcaagtagccctggagttgtgggcatttataaacaagtgcaaaggtaattacaggaaagagaatgggagaggtactctagcagtgaataatttttcattgtgttgattttgttgctgagaaaaatctcagaattcctagatttccatgtttagttacaggacatgcctttccataggaaaggctttgctgatgtccttagggcaatgcctttaacatgtccttggaactcttatatactgttggtatgaatgtatagtagtacagccactatggaaaacagttgtggagatgtctcagaaaactaaaaataggattaccatttgatccagctgcttaatatccacccaaaggaaagtaaatcaatatatcaaagggatacctgtactcgcatgtttattgcagcactattcacatggaatccacataagtgttcatgaacaaatgaatggataaagaaaatgtggtatatatacacataagggaatactatattgttcaggtataaaaaagaatgaaataatgtcatttgcagcaacatggatggaactggaagtcattaagtgaaagaagacaggcataaaaagacaaatatctcatggtttcacttacatgtgggagttaaaaaacttgatcacatggaggtagagaatggaaagataggtaagagacactgggaagggtgacttgagggagaggatgaagagaagtgggttaaagggtacaaatatacagtaaaatggaataaatacagtgtttgatagcagagtagggtgaatatacgtcacaaaaatatatactacttgggtgatggacacactaaataccctaacttaatcactatacgtagatacatgtaacaaaattttacatgtacccccatacatttgtgcaaaaaaagtccttaaggcaagactaaaaaataaagacagtgtaagtcagtcagtcaacagtttgattgccttctatgtacagtaaacagtgttagctgttgtcaggcatgtaattataatgcataaactcgatcctcgaggaatttgcaattatctgagaagattaaaaaaagtctgtgagggtaattgatgatatctcaatgccaagtgtgttataaatgagggcatttaggatacacatatagaaaatagacagccccaaatgttccacatattatataattcagtcaatcatcattacaaatcagtggaatgtactgtttattactattttacaaatgaggaaaatgccgggggtggggcatagaaagcttagttaactttcacaaggtcactgaatttaatagtggagcaggaatttaaacccaggtaatctgacttcagagtttgtgtgcccaaaacatgaatctgtattgaaagaagagaattgccagttttatcagaacaggaaaaaaaaatgttcagccttgaatgaagggtgtgctatagatgaatgaaaagagaatggggtggggtcgtgggagtgtgtggatctggggatgtgtttgtggggaggtggcacaaaatgataatgcttcaagcagcagcttgaaggtggaaattaaaatggcacaatatgcgtgtatatgtgggtggaagaatgagtagcaattcaaacctaggcgattttatgtaggaggttagttgatggtaggtgggaatgtagattggtacaggtttttaggcaagcaattttgcaacaccttaaaatttaaaaagtacatggcttcttattcagcctttcccaaactaggaatgcattccacagacgtacttatactgtattgttttaaaagtgaaaaaaatgacatagatgaccttcaaaaggagaactgttggattgtattttagtgtactctgaagtatttaaaaagatggaggctcatctatttttatagacagcgagagatgcttgtaatttattgtacagtggaacaaagtgatttgatgaacaatatgtataatatgattctattttaaaaattaatcaagtcaagaaacacttatggaagcctcactatgggctgggcactggttccagtatatgggatactgtagtggaccaaacatgcaaacagatcatactaaacaaatctctgacttcttggagcttacattcttgaggggagatagacaagaaacaataagcagaataaataagtaaattatataacagaagtatatcagtgcatgaaaaaataaaaagaaaaggagatcaggtaaataggattgggggtgctgattgggggtggggtgggagatagtcttaaatggggcagtcagggtaagactcattgagtaggtgagattttagcaaaggcctgaaaaacatcaagaggaacagcagtgggtcaaacataggccttaaattgggaatatgtctggtgttcaaagaacaccaagaaaaatggtatggctggtgtgggagaagtgaggggaagagtagatgagaggaggttgtagagttattgtggggtctggattatataggttaggactgtccaaaacaaatattatgtgaacctcatatataattttaattttttagtagctactttgaaaaaatggaataccaggtgaaattaattttgatagtatattttaaggtaatatattcaaaatatcatcattttaacatgtaatcaataaaaaagtattaatgtgatattttatacttttcgtactaagacattgaaacctgcggaatatttcccatgtaccacacatctaaatttggactagctacatttcaaattctcaatagcctcaagtggctagtggccatcatattgaacgacaggtatagagttgtgtaggtcacttgttatgatttggcttccacgtggagtgaaatagtcattgtggaagtttgagcagaagagtgacttagtctaatgtacatttaaatggatcactctgattggtgtgttgagaaatgcccaagtttggaaggaagaggggaatcgtgcatagaagcagggaggcctgttaggaggctgttgcgccaatccaggcaaaagatgatggagactcactcagatccaagtgttagcagtcaaaatggggagaactggtcagattgtagatttattttgaaagtagaaacagtgtagtttactgacatattgaatggggaaaaaggttgaaaggtgaaaaaggaatgtcaaggataatatcaaggcttttggcataagtggaaagatggaatttccatcagttgaaattgtggttctgcaggtggcacagatttggaggaaaaacttaagtgtgagattgctattatacccccaagtgaagatttgagttgtcagttggatatatgagtctaaatttgagaaagaagtctagactaaagatacaaatttgagagctatcagcgtaaataaaaattatttaaagctgtgagactggatgaggtcattaagggattgagggtagatggggaagagaagaggtctgatgactgagtcttggaaccctctaacactatggggactaataccagtctggatggatttataccatattgatgattatttttaccattacgtaggagaatttcaagggcctggccaagaaggggaacttttaatatataactgtatttttaataataaatatatataatatacatttatatattatatatataataaatgtatataaaatagaattttataataaatgtataatggttctggaatttaaaaatatgtgagcaatacagagaggacttacagctatagctcagatatataaagaagttgtgaacttatcactgttgtccttacaacaaggaaaagcttgacaactaattatcaatggatattgatgttcttatacacataagagaactgaatttgcagggcgaactttcatcgcaaacctaaagaggcaggtacctgcaggaagtcataaactgaagcatttgcttacctggggctgaagcctccagatgccatgaaaccatatgaggaacattaaactagaaagtctgatgaattgctggggtggttaagtatgggctagcaagagtgtgtacagctccttgagggccacagtcatgggtgtggggtgtggcttatacttacctaggcttttccttcagttagtacactaggctgtcattaggaagattggggataatccagagaaacctacctactgactttctctctgccttggtgattgtagaagtttctaaaggatattttcactggatataagattctgggttggcaggtttttttttttctctcactccacccaattccccgaatgactaagaagagcatagcaccctgacaacctgtgatggacatacagtgtgaacaagaaattaactttttttgtttgtattttagcaaaaacaaacagcaagttgtcagtacaatcatgttgattctggaaagcaagcataaggaaattttatgttttatattacatacagattggggaaaccattggatgtcttgaagaagagtagtatttgatttacccaataaaatcatgttctttgaatattaatccagtagcgatgtataggcaaagattctccactttctgaactaattctgacccttggctctattatgtgtctgaagttatttaataggaacaataataagaacccaaaccaagtgataattaccagaatcctattcatactattaaatagaattagctttgtgtattgtttgaggctattttttttaaaaaaagagaattttaatagtatcttaatgctttatataatttcccacaaaataatataaaaatactcatattgagtaattctacctgtttttacaattaaatgtccatcgctaaataatatttagctaggaatgtagttccttattattggctgttatgccaaaagataaaaaatttcttgttctataatgcctttaaaaatagttgtctattgaaaatatatctattttttttttctgagacagagtctcactgtgtcgcccaggctggagtgcagtggcctgatctcggctcactgcaaactccacctcattggttcacgccattctcctgcctcagcctcccgagtagctgggactacaggtgcccgccaccatgcccagctaatttttttttgtattttcagtagagacggggtttcactgtgttagccaggatggtctcgatctcctgaactcgtgatctgcccacctcggcctcccaaagtgctgggattacaggcgtgagccaccatgcccggcctatatctattttttaccggacttttaattaaataagaatctagagattttacctaattaaggaaaagcatgttggcttcagaaataatttttatgcatgccccataagtctttgaaaagacaatttaatattatgcctaatgttatttttgctttgggagaaaagtaacctatagccccaaaaagtcttatatatgatgggttgtcactcatggcaacttacagcaggaaggattgggtctagattttccttactttgcctcagatttttcattttcgaaaaaatgccccttttcatgtgttgcaactgaggagagttatgagtcaaacgcatcctgttttcaaactcatacatgatattttggttaataaatgcatcaggacctggaggacaattgacatataaaagaaacatagaaagaaggcagccaattgtgtctgtttacagactaaatatgacaaaaaaaggtctgtgagagttttaagttctgcctgttccctagaaatttctactcatttgaagatgaaccttgattgaaatgtaaagtttcaacttctaagaagctgagtaacatacacagcaggaactgccaatatcgttttaatagacatgtcttgtaaaggtgaatttcaatgagttttcagagctttctgaacagtattatcacacgttttaagtaaataggtcaatgttatcatttatgtataattttattgctttagtgctatatttttatgattattttacaaatactttactaagaatatactgaagtctcctgatgattttatgctctttcttattcttgttttactcgagaagttttaactttgaatccctacttagctactttaaaacctgtctcatttttccaacttacaccttgcatcatctctctttccttagagcccagacatcttgcggagccattcacttcttcctaacattttagatactccaatcttttttctatatttgattatttatttgtgaatctcaagaacagaagtagtctatccccaaaacatgcagagagctggaaaaagtatagacatatacaatttaatggaaggaaggaaggcaggaaggaaggatatgaattatatctctaaattggaaacttcaagccttatgtctttataatgatatatcataatttccttttaaaagtcaggaactcagaccaagacacaaactcatgcacatgctaaactgtgaaagcatacatttacctgtggtgacgttagctggcagttttagttggctcagaaaaataatcttacataaggaaagagcctccctccatgagcagccttgaaagtagaaaatttaggaagaatgtgtcaatgatcaaatctactgaaaatcagcaatatcttttgcatacttgtggagtaaggtgtgacaagttattagtggtatggatggctgagcttttctggaaagaagaggacatttttcaaatgtgccttgtattgtgcatggtcctttccatggttatacctacatactggccagttgtaaacattagatcatattaaaatcattcatggatctttcaaaaagacttagactcccacacaatagtagtgggatactttaacagcccactggcaatattagacagatcatcgagacagaaaattaacaaagatattcaggatgtaagctcagctctggaccaaatggatctgatagatagctacagaactctccacccaaaaacaatagaatatacgttcttctcattgccacatggcatttactctaaaattgatcgtataatcagaagtaaaacactcctcagcaaatgcagaaaactgaaaccatataaaacagtctctgggaccacagtgcagtcaaattaaaactaaagactaaggaattcactgaaaaccgtacaattacatggaaactgaataagctgctcctgaatgacttttgggtaaataataaaattaaggcagaaatcaagaagttctttgaaactaatgagaacaaagatacatcgtaccagaatctctggcacacagctaaggcagtgttaagagagaaatttatagcactaaatgcccacatcaaaaagttagaaagatctcaagttaacaacctaacatcacaactaaaagaactagagaaccaagagaaaaatcaagccacagaaatacaaacaaccatcagaaaatattacaaatacctctatgaacataaactagaaaatctagaagaaagggataaattcctggacatagacaccctcccaagactgaaccaggaagaaatagaatccctaaacagaccaataatgagttctgaaattgaggcagtaataaatagcctaccaatcaaaaaaagtccaggaccagatggattcacagctgaattctacccgatgtacaaagaagagctggtaccattcctactgaaactattccaaaaaattgaaaaaaggggactcttccctaactcattctatgagaccagcatcatcttgataccaaaaccctgcagagacacaataaaagaaagaaaacttcaggccaatttacttgataacattgatgcaaaaatcctcaataaaatactggcaaactgaatccagcaacacatcaaaaagcttatccaccacaatcaagtaggcttcatccctgggatgcaagcaagcttggttcaacatacacaaatcagtaaatgtgattcatcacataaacagaactaaagagaaaacacacatgattatctcaatagatgcagaaaaggcttgtgacaaaattcaacatcccttcgtgttaaaaactcacaataaactaggtattgaaggaacatacgtcaaaataataagagccatgtgtggcaaacccacagccaacatcgtactgaatgggcaaaagctggaagcattccccttgaaaactggcacaaggacgcctgctctcaccactcatattcaacatagtattggaagttttggccagggtagtcaggcaagagaaagaaataaagagtattcaaatagggagagaggaagtcaaactaacacttttgaagatgtttaaaaaaagcaatggggaaaggattcccttttcattaaatggtgctgggataactgtctggccatatgcagaagattgaaactggaccccttccttacaccatatacaaaatttaactcaagatggattaaaaacttaaatgtaaaacccaaacatataaaaattctggaagacaacctaggcaatactattcaggacatagcctgggcaaagatttcatgatgacgacaccaaaagcaattgcaactaaagcaaaaattgacaaatgggatccaattaaaataaagagcttctgcacagcaaagtaactatcaacagacaacctacagagtgagagaaaaatttttgcaaactatgcttccaacaaaagtctaatttataaggaacttcaacaaatttacaagaaaaaaacaccaccccattaaaaagtgggcaaaggagatgaacagacacttctcaaaggaaggcagacacatggacaacatgcatgtgaataaaagctcaacatcactgatcattagaaaaatgcaagtcaaaaccacaatgagataccatctcacaccagtcagaatggctactatgaaaaaataacagatactggtgaggttgtggagaagaaagaacacttatacactgttgatgggagtgtaaattagttcagccatcgtggaagagtgtgacaattcctcaaagacctaaagacagaaataccattcaatccagcaatcccattactgggtatatacccaaaggaatataaattgttctatcacaaagacagatgcatgcatatgttcactgcaatactattcacaatagcaaagatatggaatcaacctaaatgcccatcaatgatagactggataaagaaaatgtagtacatatataccattgaatactatacagccataaaaaagaatgagatcatgtcctttgtagggacatggatggaactggaggccattatccttagcaaactaacacaggaacagaaaaccaaataccacatattttcttttagttgggagctaaatgttgagaacccataagacacatagaggtgaacagcacacactgaggcctaccagagggtagagggtgggaggaggaagaggatcaggaaaaataactaatggatactaggcttaatacctgagtgatgaaataatctgtacaacaaacccccatgacacacatttacctatgttacaaagctacacatgtactcctgaacttaaaataaaagaataaaaaaaatcgttcatgagtctttacaaaatcttaatacctgagtctcaggattgagattcgaagtggggagggggactggaggactttttttgagttgataaagaagaaactggtactttgaaagaaggtatacgtttcttccttcctcctttttggtaatattctggaatcactgatccttaagactcccaggattttcaagttgtattctgttgcatttagatgcaaaataatctaatgtagtattttccacaatgagcttcctgaaaggctgatcttctctgaaaatgttagtaacctcatatgataaataagtaaatactaatgagtttcttccaaaatatgtttagaactctaagaaaatcactaaagaaatgtaaatagttcttactattatgcaatactttttcattagaaatacagtaccaaatcaagaatgccaaggagaatgagaaatcattcattactttaatctgttcaattaatatttttgagcatctactatatgcctggtatagttgtaggtgcttgggatacatcagtaaaatgcattaatacatgactttaattctgcagcatttagaaaaaaactctctgatgtttgatgggtttttaaaatatcgtataatgttctttattcatttttcattcaaatttataaatgaattaaaaaataaactaaaccagactaatttgctttattcatatgtaaagttaaaaataattagatattgatcatttcttacaagatttatttcattgattccttttattcttttgctgtcaaatacaagagtgaatttctatgaactgtggagattttcaatgcatttgaattaaaagactatgatgaacagaaaatgacacatccatacatgaaacttctctgtaagtgaaagctttattatatatttctttggggaaaccttttgccatgaagaaatgaagcaggttctgaaataaatttgaaacaaaatttttatgcaacttaagcaaattttacattggtaaatcacgtgatttattagaattttacaaatattacaaatgtaacatcttacactttatcaagctaaacaagaaatagaatcttttctggttgactggctgacatgaaatagtttttgattcaagcaaacttctgcaagtagctctttgtaaacagaaaaataagatagatggatatatatagataaatacataaaactaacttatttgactcttatttggtcccaccagttgggcttttagggatgttttctgcattcaggaagtttcttgaaataaagatgagtatttgttgttatgtttgtctgcagagaacagtctgcaaatagtcatatgtgtttcataaggatcgcctcaactttcttttttgtttctgttttgtttttgcatataggtagggttagacataattgtaaatactccttcttaaaaaggatatatatgcatcggaatttaggaaatggtcatataatggctttgaatcagattaacctggatttaatacaggtccctaggtattgtggaccctcatacccaattctctttgactttgttttgtcatttgtcacataaagatattaatatttaatatacaaggttgttataaatcaataagataataaaagtgtaaagagcactgcactgaacctgccttatggtaaggattcattggaaagtaattatttgttattactgttattattattaagcatctattatgtgttagggttgggaataataaatggaatattatattgggcataggtttcaagtgtagtgtctagttggagaactaaagagtatatgtttgaggtaataactaaaaataaaaacagtagtatggatgagaatagacagtttttttttaaatgtaagctttggaggtttttgtgacataaatattataaatggtcctgaagaaatctgaacctaaatttcttcatgtatacagcccatttatactgttcattaggtagaaaccagctcgtagatgaccttcaataaagtttgtattgattgctaggtttttgaggaaacaaaaacaagagacaattcaattttcccagcttatttctttttgaacagtagaaaggtgttacatcttgttgctgccaagtggagcagattaaaggtcaggacagcatgcaagatctgtttctctaataggaacattccagcacacaggaatgggggatggagtaatttttagtctatgtttctcatgaaagtcaagaatagcataacattagaggtacttttttggtctcatgtttattcagtagctttgaccgtagagttttttcctatttagtgactatattctacttggaaaatatgatgtaaaagaaattcgtagagaaaaatgcaaataccgttgcatatccccaagtaatttatgctttttcttacccccaaattcttgaaatatattcatttgtaataaaaaaagtccctgcacctggagttatcttttattttcctttctttttttaattactctgacatataattgtaagatacatatttatgaagagttgagacaggccagaatcaaattttcttgtccagcctacccagctgctgatggccatctctgagataaccaacttgctcacacatgctcctaatgatttctgttatatagttgagagggagtgtccgtctgtcagcactaaatgctatttgtgaaattaatggcacaaggaaacaatgtagctctgatactagttgcagctatacatgttagctgattttgaaaaaaggttggaatttagtaatatctttcagtcacatggtatttttccctctactcttcccctggttcatggcattctaagcatatcaaattacctactacttgttattgcaaatgatacttttaaatttctgatttgagatattacttgacccatataaaaatacaaaatgactgatttttttttattattatactttaagttctagggtacatatgcacaacgtgcaggtttgttacatatgtatccatgggccatgtgggtatgctgcacccattaacttgtcatttacattaggtatatctcctaatgctttccctcccctctcaccccaccccaccacaggccctggtgtgtgatgttccccttcctgtgtccaggttttctcattgttcaattcccacctatgagtgagaacatgtggtgtttggttttttgtccttgagatagtttgctgagaatgatggtttccagcttcatccatgtccctgcaaaggacatgaactcatttatggctgcattatattccatggtgtatatgtgccacattttcttaatccagtctatcattgatggacatttgggttggttccaagtctttgctattgtgaatagtgtcacaataaacatacgtgtgcatgtgcttttatagcagcatgatttataatcctttgggtatatacccagtaatgggatggctgggtcaaatggtatttctagttctagatccttgaggaatcaccacactgcttccacaatggttgaactagtttacagtcccaccaacagtgttaaagtgttcccatttctccacatcctctccagcacctgttgtttcctgactttttaatgatcgccattctaactggtgtgagataatatctcattgtggttttgatttgcatttctctgatggccagtgacgatgagtattttttcatgtgtctgttggctgcataaatgtcttcttttgagaagtgtctgttcatatccttcgcccactttttgatggggttgtttgtttttttcttgtaaatttgtttgagttctttgtggattctggatattagccctttgtcagatgagtagattgcaaaaattttctcccattctataggttgcctgtgcactctgatggtagtttcttttgctgtgcagaagctctttagtttaattagatcccatttgtcaattttggcttttgttgccattgcttttggtgttttagacatgaagtccttgcccgtgcctatgtcctgaatggtattgcctaggttttcttctagggtttttatggttttaggtctgacatttaagtctttaatccatcttgaattaatttttgtataaggtgtaaggaagggatccagtttcagctttctacatatggctagccagttttcccagcaccatttattaaatagggaatcctttccccatttcttgtttttgtcaggtttgtcaaagatcagatggttgtagatgtgtggaattatttctgagggctctgttctgttccactggtctgtatctctgttttggtaccagtaccatgctgttttggttactgtagccttgtagtatagtttgaagtcaggtagcatgatgcctccagctttgttcttttggcttaggattgacttggcaatgcaggctcttttttggttccatatgaactttaaagtagctttttctaattctgcgaagaaagtcattggtagcttgatggggatggcattgaatctgtaaattaccttgggcagtatggccattttcatgatattaattcttcctatccatgagcatggaatgttcttccatttgtttgtatcctcttttatttcattgagcagtggtttgtagttctccttgaagaggtccttcacatcccttgtaagttgaattcctaggtattttattctctttgaagcaattgtgaatgggagttcactcatgatttggctctttgtctgttattggtgtataagaatgcttgtgatttttgcacattgattttgtatcttgagactttgctgaagttgcttatcagcttaaggagattttgggctgagacgatggggttttctaaatatacaatcatgtcatctgcaaacagggacaatttgacttcctcttttcctaattgaataccctttatttctttctcctgcccgattgccctggccagaacttccaacactatgttgaataggagtggtgagagagggcatccctgtcttatgccagttttcgaagggaatgcttccagtttttggccattcagtatgatattggctgtgggtttgccataaatagctcttaattattttgagatacgtcccatcaatacctaatttattgagtgtttttagcatgaagggctgttgaattttgtcaaaggccttttctgcatctattgagaaaatcatgtcgtttttgtctttggttctgtttatgtgctggattacgtttattgatttgcgtatgttgaaccagccttgcaccccagggatgaagtccacttgatcatggtggataagctttttgatgtgctgctggattcggtttgccagtatcttattgaggatttttacatcgatgttcatcagggatattggtctaaaattctctttttttgttgtgtctctacccggctttggtatcaggatgatgctggcctcataaaatgagttagggaggattccctctttttctattcattggaatagtttcagaaggtatggttccatctcctccttgtacctctggtagaattgggctgtgaatccatctggtcctggactttttttgattggtaggctattaattattgcctcaatttcagatactgttattggtctattcagggattcaacttcttcctggtttagtcttgggagggtgtgtgtgtccaggaatttatccatttcttctagattttctagcttatttgcatagaggtgtttatagtattctctggtggtagtttgtatttctgtgggatcagtggtgatatcccctttatcattttttattgcaactatttgattcttctctcttttcttctttgttagtcttgctagcagtctatcaattttgttgctcttttcaaaaaagcagcttctggattcattgattttttgaagggttttttgtgtctctatctccttcagttctgctctgatcttagttatttcttgccttctgctagctcttgaatgtgtttgcttttgcttctctagttcttttaattgtgatattagggtgtcaattttagatctttcctgctttctcttgtgggcatttagtggcataaatttccctctacacaccgctttaaatgtgtcccagagattctggtatgttgtgtctttgttctcattggtttcaaagaacatctttatttctgccttcatttcgttatgtacccagtagtcattcagaagcaggttgttcagtttccatgtagttgggcgattttgagtgagtttcttaatcctgagttctagtttgattgcactgtggtctgagagacagtttgttataatttctgttcttttacatttgctgaggagagctttacttccaactatgtggtcagttttggaataagtgtgatgtggtgctgagaagaatgtatattctgttgatatggggtggagagttctgtagatgtctattaggtctgcttgttgcagagctgagttcaattcctgggtatccttattaactttctgtctcattgatccgtctaatgttgacagtgcagcgttaaagtcacccattattattgagtgggagtctaagtctctttgtagatctctaaggacttgctttatgaatctgggtgctcctgtattgggtgcatatatatttaagatagttagatcttcttgttgaattgatccctttaccattatgtaatggccttctttgtctcttttgatctttgttggtttaaagtctgttttatcagagactaggattgcaacccctgccttttttttgttttccattttcttggtagatcttcctccatccctttattttgagcctatatgtgtctctgcacgtgagatgggtctcctgaatacagcacactgatgggtcttgactctttatccaatttgccagtctgtgtcttttaactggagcatttagcccatttacatttaaggttaatattgttatgtgtgaatttggtcctgtcattatgatgttatctggttattttgcttgttagtgggtgcggtttcttcctagcctcgatggtctttaaaatttggcatgtttttgcagtggctggtactggttgtttctttccatgtttagtgcttccttgaggagctccagacctgccctacaagaatgactgattgttagagacttttttgtgtttctatggaaaaattaaaacatatgtgagagagtaaactgctgattattctatacaaagccttctagcatatctttctgactttctgtaaatggaacatgacttgacgtctacctccaactcaatttgttttttttttttttttttctgagacggagtctcactctgtcccccaggctggagtgcagtgatgcaatctcggctcactgcaagctctgcctcccgggttcacgccattgtcctgcctcagcctcctgagcatctgggactataggcgcccgcaccacgcccggctaattttttgtatttttagtagagacgaggtttcaccgtgttagcaaggatggtctcagtctccagatctcatgatccacctgtctcggcctcccaaagtgctgggattacaggcatgagccaccatgcctggcccttggtgtgttttttaaaacacaatcaaacacataaacattcacaaagaactacttcagaaaaacaagaattcactggactagagaggacctttaaaaaatctgaaagcttctttgacaagaaaggataattgctgtatatctttcttattgagtataattttcgtttacatattttattttgtgtgtttttaaaaattattattaccgggtaattatgatagatataactcagaatacgcataggtcaaggcatgggatagggattgtatggagcttccatactccccactgtgtgccaccctcttagcacatctgtgttttcaccaacccagaagttcttcatacaattttaaaacgtaattaataaaagatcttgcaagtctctgaattttcttaccttcttactcataggatcaggcaaatttcaatctctttgtgaaaatgctaacatgttgagaatgagcaaggcagagcagtggggtggataattctaataataaatcatgaacaaaagtaaatggtgatggctgtgatggtgtgaaataacctgatggtggcataggcctcttgaaggaatactctgggaatctcccttgtaacacttttaagagcaaatttaaaaaatcgagactatttatgcatttttgttgtatttagaaaagcatcatgtacttaaatggaagaaaaaaagtgagggatacttccagtgttggatggttaagtttttctgaagtctatgtttattttcaaagttatttatgacaatgaaataatatttaatgctacagctatcacagtgcactcatttatttttttctaaattgtgaagaatacatggttaataataggtttcagataggtatctggattcatgtgaatgaacttaaaaagacagttttgatgatcattctgttgaggatagaactgtggtatatgtgatcatgggttttatttttctcatgtgtaaaatgaggtatataatctgagtctcaggtgactccaaatttttaccattcttcacatattgatattatgttcaagaaatcaatagggataagggggaattaaggataataatttggttctacttaataacacacactacttgattattaacaacattgcacgcaagtgttaatacagctcatttgctttggatggaagctgtaatgtctaagattcaagcataccttcctttggtgatggccttcattcattcaaccaatatttttgtagtgactgttgtgtggggattgtggtagaattaaaactttaaggaaaaacctattataaaactccctcacaaaaaatacgataaattgaaatttaaacattatttaagaaattttattacttggcagataataaatgatacttactgagtgctaccacacccaggcactattcaattcactctacagttattaattgacttatatcatcctcatagtgttcctatgaagtaaatgtcattatttcccccactttacagatgaggaaactgaggtatagagagaataggcagtttgatcaagcttttaagattggtgaatggaagagtgtgatttgaccccagagctctagtgcctgcatgcttaaacactatattgcacagcttcttcatttagatacattgcagaaacagaggaatctaattgtagatgcatctggctcaactcctttgtgaacatagtagtaatgtaatcagaagacttatatcctcagttttattcttttatggattttatatgggaccaatgataaactttcttcatttaccccagtctcttaataaaaataattttccaattctgtgaagaaaggcattggtagcttgatggggatggcattgaatctgtaaattaccttgggcagtatggccattttcacgatattgattcttcctacccaggagcatggaatgttcttccatttgtttgtgtcctcttttatttcattgagcagtggtttgtagttctccttgaagaggtccttcacatcccttgtaagttggattcctaggtattttattctctttgaagcaattgtgaatgggagttcactcatgatttggctctctgtttgtcttttgttggtgtataagaatgcttgtgatttttgtacattgattttgtatcctgagactttgctgaagttgcttatcagcttaaggagattttgggctgagacaatggggttttctagatatacaatcatgtcgtctgcaaagagggacaatttgactccctcttttcctaattgaataccctttatttccttctcctgcctaattgccctggccagaacttccaacactatgttgaataggagtggtgagagagggcatccctgtcttgtgccagttttcagagggaatgcttccagtttttgcccattcagtatgatattggctgtgggtttgtcatagatagctcttattattttgaaatacatcccatcaatacctaatttattgagagtttttagcatgaagggctgttgaattttgtcaaaggccttttctgcatctattgagataatcatcattctcagtaaactatcgcaagaacaaaaaaccaaacgccgcatattctcactcataggtgggaattgaacaatgagatcacatggacacaggaaggggaacatcacactctggggactgttgtggggtgggggaaggggggagggatagcattgggagatatacctaatgctagatgacgagttagtgggtgcagcgcaccagcgtggcacatgtatacatatgtaactaacctgcacaatgtgcacatgtaccctaaaacttaaagtataataataaaataaaataaaataaaaaataaaaataattttcattagagtgtatatgagattatgatgatggatttcttattatatcagaattatattttcataaattcagataacactgtacagttattgttgaatactatactatgtataaatgtccacaaatcaaattttaactattcaagggtgctttcctttcaaaattagcagaaagattacgttttcaacagttaattaaaccattttgaaattacaagagataatgtagaattgtatccaaagtcttatacatttgttctggcaatacctttattcagcaagagagaagaatttattctctgcagataaccgctactcacccacaaacagtccaacatacagcccagagatgtaggcttctcattttggaaatacaaactgtttacaatgagagtatctctaaaaaaattgtttcttaggaggaaagatcgttctatcttccaggaaagggaaactccaagaagtttctttattctaaaaaattaagaaagaccctcaaacctcaaagcacataaaggagacttagcaaacaatattctgtaatatttgcagaaaaacataaacacagcatctttactaatgtttattttccaaaaatatggtaataatagacatttattgggaacttccggcattgcaatgcagaacacttttttataatgaatataaactcattatatagatgaagaagctgagttgcaaagaagtcaagtaggaaactcatttaaaccctctggagtcatgtccttccacagtgttttatatttactttcttgtagatattatggctattctaaatatttggatatttgctgctctaaaagtctttttccttaaagaaaatttttcaagttgtatttctttttcactttaaaagttattttaaacttaaagggaactttacagcccattctagctatgttactctgtattatcatttgcttatatcaaacattttgcatgctactatgactataaatatatcattttaaactttaatttgtgcaaatttaaaatgattgacttttattttgcagttagcaaataagctcccagactgaccaaaatgcttttaagggtcacatttatgttaaaaaattatatgtataaaattcccattgggaaaagtttgattccagtattcttatgtaatagccaagggagtgccagttaagtacaaatttaatagcttttctaggtaggactccagaattagtgcatgaagggaacatagttaatctgtttgaagagttcattaaattaggttatatatgctattatgaaatatagaggagcataaaagtatccagaggaaagcatagaaacaatgcaaattacttagaaccaaaaagattgatttatgatgaattattaaagataaatggatcttaatagtaaatgctctataaacagagtatatgtctaatgccaagatgctaagttcaaagaagctttacctaataattaatgaggactggaaatactctagcattctagatatagttgcccaattaaatatgttatagaaaattatctgaaaatgggaagctaactgagctcatccaaaatttagatgatgacttatttcttccagttagaagatagggatgaggccgggtgtggtggctcatgcctgtaatcccagcactttgggaggccgaggcaggcggatcatgaggtcaggagattgagaccatcctggccaacatggtgaaaccccatttctactaaaaatacaaaaattagctgggtgtggtggtgcacgcctgtagtcccagctactctggaggctgaggcaggagaatggcgtgaacccaggaggcggagcttgcagtgagccaagatccatctcaaaacaaaaaacaaaacaaaaaaaattatgacttgaatttcaattatgacttgaaattatcttatgatagtttctaataggtggttttcctcatttgtttcaattataattaaaaatagttttataattattatgacacttgtaaagatagtaaaactctgtttcagaaagcttatccatttgctgaagtttgtattgctctctcatctattccttgaagaactttaatattgaaggaaaacaatgacaacttttatgataggaaattcccctgcttaactaaaccagcacatattggtctcaaaaattgagatgacctgaatctttgaatatagtttttttacacgttgagcattgtatatagttagaaagggctatagaaactgtttcatgtttaaataattatttctttccttttataaataatataaagagtatatatcagttatgtattcagaggaacacttccgaaaaacgactaaatagatacttggccatattttctacaaaattatctaacatagaatgaacatatttattcaataaatgtatgctgaaaaaagctacatcataagtaaaatgaacaataaaaaaactaataatattttccagttttcttgataatgatttacacttgttgaactgtgatgtgtgatatacttgttgaacatgctaaggaatattaagccatgccctaattttcattattttacattcatgcattaacttgagcaagaccctaagatttatttataggtgccagttcagaaagtttttcttgctgtgaaatcctagacctgatgttttaacatatatatggactttgaaaccatgttcatttaatgcctatgaccaatagttttaatgaatgcctaacaacttacttaaaccaaacaaataattagtgtcaattacagaagtgtaaatttgactctaattaatgaatgtgccagactctacgcattggtttaagtgtaattgatcttagggccactgagatcactttaagggttggaaaaatgacaacaagtaggaagtgactcagatgtaagaatgctcactcctagaaagattaattggtgtattagtgataaactagtgggtggctgatgtaataatgatatccctatattaagatgcctcaaaataggatcaccaactctaaagcttgtaagtttatacaattactatgtcaaatatactcttttaaaagaatatctgtcacgttcatttgtccttttttcattttgattttttttctttttcatcattataaaaaaaacatcctaagggaagcatactgatgttttactttatgctttgaaatgttctcactgaactgtgttggtaggcctgggtgtggtaaattaagtggcttgtattaaaaagacaatgattgctagctagtatttttccattttctttgctgtcagcaaagtctgcttttgttgccatgataacttctccccactttgatggtgaaatctggaaggacaaaaaagaagggcatttctattgtgctattacatttcttctcttttgaagaacttctaatactttgaatgatgggttaaaaagccgagatgatgtgatgaagctgaatggtgggcaaaagctaaattatggcatattcatttttttatcagtgcgtgaaaggtcactggctgagggagagacaggcaaagtcctagatcaagagagtgagaggtggctgctaagtggggagttgagaagatcagaatactacggagtctttgtcctttttctgactattccctgcctatgttttttccctcccttctttctcccctacctcctaaccccagacaactgtcctaatgaaaagatttttaagaaagatgtcaaagaaaatagagtttttaaagaaagatgtcaaaggaaattgttgaatgaggcacaggggcagcatgagaccagagtggaggaaagtgataaaggcactttttagaagttaagcccagaaaactggggcaagaatcaaagcgacgctacaggcagggatgaggtaaccagggtcctgaagataatcataaggagctggagtctgaggcaggaaaaaaggcaagtctggttaagaggtttaaggcagaggatgacctacttagaaaaagatcttttcaacagccagacttcggactagaggggaagtaggtcaagaggcctgagagtaggttacattcgtctgagaggaagttgttttgactaaacaagaagttgtaattataccaaattatgagatcgttaaattaagtagtcatgtgcaataacatttcctccttaaatatttttaaacatttttttagcagagttgttcatcatacatcaaattttaatttgcattatgttgtgtagtacaacttcatttagactacttcagtggaagaacaatcgaaatttacgaacattctgaaagagttggaattttgcttcttgtccgtatataaataggatcaagttaacctttcatactgtgtgaactcctttgtcttatttcttcgagggctttttaaaagataagaataatgaacgtgaaagggattttataaaaacatgattaattcaggtaattgaaatagtttgatatcctaagtagtttaagcattctttctgctacctcatttggattaatagtttgtttcatcccagcactttgggaggccgaggcgggtggatcacgaggtcaagagatcaagaccatcctggccaacatggtaaaacccatctctactaaaaatacaaaaattagctgggcatggtggcacatgcctgtagtcccagctacttaggagactgaggcaggagaattgcttgaacccgggaggcagaggttgcagtgagccgagtttgcgccactgcactccagcctggcaacaaagtgagactctgtcttaaataataataataattaataatttgtttcaaaatacagcaggatggtatagtgttaaacacataaattctagaggcagattacctggattaattcctagctctatgattttctacccgtgtgaggatattggatcttaatgtttatatgtcagttctctcacctgtaaaatgggctaatagtagtgactatttcatagagtggttgtaacaatttattatacaggtgtgtgtgtgtgtgtatataatatatacaggtgcacacacagttatatatatatatacatacttaggacagtaacagaaacagagaaaatgcttatcaaatatttatgattattatgagcaatgttaacagtaattatatgtatcctaaaatacttctaaaatagtaatgatactattaatccaatcctaattttaatactaatcttaacaatatttttgtataccatcccccagctcctcctgccatttcttttctcccctttatagtaaaactcagaagagttgcctgtgcttgctctcttctcatttctcttagacctcttccagtctgggttttggagccaccactccaactaaactattcctaccaaggtcccgaatgtcctccacattgctgaattagacccaattctcaatccttaaggcagatagttgacctatcagcaacaatttatcacctacttctttgatgatgtactgtcttcacttgtctttcagaattgactcttggtataccttcagatttagttggtctttctcagccttctttctgattttgtcgactctcgtagacttctcgatgatggaagaagccagtctcattccttggtcctcttctcaattcacttccttagtcatttcacctagtactgtggttttaaatatcatttgattgttgacaattttgactaatttattttctgtttccagctcctctcccaaattccagattcgtacatctaactccttactcaagattttcactgaaagcacttatagacacttaaaatttaatatgtccaaaggctatagagccaatatcctcctcagaactggttccacaaacacccattcccatatcagttgctatagttccctgtgtctggttattcagaacaaatttctttgagtcatccttcactcctctcattttgttatactccacatcaaacagttctcactttctgttggcttgaccttcacaagagatccagatggtgaccatttcttaccacctctgctgctacaaccctactttaagtcactatcatttctctcctgaatttatgtgatgacatctggtctgcctgcttctgctcttcccctcttcaaatctattctcaacacagaagtcaaatgtcagtaaaatcctgtcagtcctcaccttgaaaccctgcagtgaaaccacaattcattcattacaaatgaaaagtgtttacaatggcttccatggatttatatagtggcccccattatttcttcttatgtcatctactcctattttccctgtaatttgtgttactctagccacagtgacacctcactgtttctgaaacatgctagacatgtgcctaccttaaggatttgcatttgctgttccctctgcctaaaaccattttcccatatataatcccacaattcctttacttcttttaggtctttaccaaagtgtcatttttttttttttttaatgtggctcttcctctagttttaaaactataactctctaactcctgactgtcacctctggcatttcccatttctcctaccctcctctagagcttagtatatgttccaacatcatgtaccatttacttatttgttatgcctgttatttatcagtcttctactagaaagtaagctccatatgggcagggaacatttttcatttactggttggatcagtacctattattttgtaggcactcaataaatacatgtcaaatgaatgagtgaatgagtattctgttgttttttcctctcccctacaaatattatgttgaaaagggttttcctcaaatgcagatcttatgcaagatacctgcatgatataggcagtgaacatcatctgctactttcgtttgctaatacaacaggcaagctcaacgtgaaaattacttactgtggcatccagtgttgctctccacatctggaatgtgtttccttaatcttatgaaacattactttcctatcaagttctgtaccacctatgaagtttttcttctctggacattcttgccaactgtgatttccaattctttagaattggtatagcacttatttttcttactatacaatttagccaatacattttatattaagtttcattgttttgtctcttcaactagcttgccaagtcttgaagggcagaaatcacatactatgccttctggtaaagcaatgtacatgttcacactccaatctatagagtattttttttttaaatcttcaaaataggttttgtctcttcaactagcttgccaagtcttgaagggcagaaagcacatattatgctttctggtaatgcaatgtacgtgttcacgctccaatctatagaatatttttcagaaaaaaatttaaaaataattttccaggaagattcctcagaatcttagtggtaacccaggagcagtggttcatgcctgtaatcccagagctttgggaggccgaggtggaaggattgcttgaggcccggagttcaagcccagcctgggtgacatagcaagaccccatgtcttaaaaaaaaattagctgggtgtagtgacacacaaccgtagtcctagctgcttgggagcctgaggcaggaagattgcttgagcccaaggattcgaggctgttgagctatgatcatgccactgcattccagactggacagcagggcaataccctgtctccaaaagtataaaattaaaaaaaaaattagaatcttagggataaattgcttaaaaacaagataaagtttcaaacaaatacctaatatacaactgtcttcaaaagacattttttagtattaatgatttaaagtattttccctttcatatttccttccttatgggtaaggaatgtggaatgtcaagccatttttcatgggttttataaatactacctattgattattcatgaaataatatgtccttttatgctttgttgttaaattcaagatattatatagcaataaaacatttaagtatttgctgaatcaaatgaccaaactggaaagaagtgatggtcaattagaatgtatacaatccttgttcattaaaatgatggctcacaggctgggcgtggtggctcacacctgtaatctcagcactttgggaggccgaggtgggcagatcacaaggtcaggagttcgagaccagcctggccaacatagtgaaaccccgtctctactaaaaaatacaaaaaataagccaggcgtggtggcgggcacctgtaatcccagctacttgggaggctgaggcaggagaattgcttgaacccaggaggcagaggttgcagtgagccgaggttgtgccattgtattccagaccgggcaatagtgtgagactgtctcaaaaaaaaaaaaaaatgatggctcatagatgatattcatgaaaaggttctctcttgccttacaaaactcttctacttatctgttaatgtatacagttaattttctacaattgcataaatacatgcacattaaacattaaaatgacttagtttatgttccaaacttacaaagccaaataaagtcagtggtaatgacagacctttaactctccccattgttcttaatggcaaccattgctactaagacagcctgtgcaattattcagtatctcaggagtacaaaccatatgctggataaaaaagtaggcaaaataagcttgatgtattaacactaggagactgcaggttgtattttgtttcatagatttgagagaatatttttattttgtttttcactattttttttccttcaggagtgtgttgcatgtttattgtcttgtgttatatatgcaacagtagattttcttaactctgtttttataaaatgtcatggattctttcattccattaacttctttgaatgttatgaaaaatgagtgttatgaatagcttaggagacttgagtgtttggagaaactgaggagacttggaggggctgctcagccctgaatatttccttttcttttcttttcttttcttttcttttcttttcttttcgttttgtttcttttcttttctcttcttttccttccttccttccttccttccttccttccttccttccttccttccttccttccttccttcctttctttcctttctctttctttctttctctttctttctttctttctttctttctttctttctttctttctttctttctttctttctttctttttttgagatagagtctcactctgttgcacaggctggaggacagtggtgcgatctcggctcactgcaacctctgcctcccagacttaagtgattctcctgcctcagcttcctgagtagctgggattacaggtgcctgccaccatgcccagctaattttttgtatttttagtagagatggggtttcatcatgttggccaggctggtcttgaactcctaagttcaagtgatccacctgcctcagcctcccaaagtattgggattacaggcatgagccactgtgctcagccagccctgaatacttctgaagtcctttcatttctctaaatattaagagagcaaacaatagaaaagtaataatcaacaaacttgatttcttacaagaaggcttatatgccaatgttttaaagttttaacattttaatatagagattttacatggtttatgttatttcctttttagtatatctttttaacttcttaaagacacaacaaatatggaatattaaacttggataaacaactctttcattataaaacaattcatccaacaaaactgtatcaaatgcctcctcagtgctaagcgttctgctagtcattggtgatacaagttgaatgaggcaaccaatgaccgaggcttcttactgttcacattcaagtggaagtgtgagaaaataaaaaatatgtaatgtagaaaagaaggaaggaaggaaggaaagagtcagggagggagggaaggaaaaaaaaaggggaaaaaagaagggaaataattatccattcagataattgctaaagcagaagtacacaggtacagtgaatagcaatttgcagccagaaaatcactattatatacatttctttgcatgtttccaaataaataactcttccaaatatctaatctctttttttaaaaaaaaaaaatcttagaacattattgaaaactagtttatgggaactagaattgtcctacaggacagaaaaatttggcccaagcagcccagttttagaaatctacttcatgttaacattattttacttagctgacaaatatttactaaatgcttattatgggccatgcactgattttggtgatatagcagagaacaaaaataagtccctgacctcatgtatcttataagaagtaggtgatgattgtaatagatcagtggatgataagcactctggacaaaaattaaaactgggggagagttatgtggtgtctgggtggaagatgttggagttctctagggtggcaaaagaagacctcactgagaagcagtcatttcaactaaatgctggaaaaggtgagggggtgagttatgtgtgtattagatctagagaaatgcaggtgcaaaggccataaggcaggcaccatactggttcaaggaaaaccaagaaggcttgtgcggctgcagtagggtaagaaagagggaggttagtgcaagatggagttagaaagataatgttgttaggagtgctttttaagggttttggagccaagaattaaacaaaaatctgcttgatggcaggaggcagcagatgacatctgtttgctactgtccttccatgtgggttgtatcattcctaggtaattgttctcatttctgaccaggagtgttagtcttttctaattagcatcctaattattttctccaactcatcttctacttggctgtctaagtgatctttccataatgcatgtcccatcttgtagtctcaatttaataccctttggtgacactccattagctttgcaaaaagacaaaggtcttaaatggtgttcaaggcccttcataatttgatgtctccaagatacctacacagcattcctcctctgggtcttgacacttgtagttccctctacctggaatgttcttttcccatttcttcccatgacagctttcttttaatcttttaaattcctatttgaatgccaccttcactgaaagacattcctttcctgaccactctttctaaagcaggtgacacggagtctatattttccatcattatcatgctgtaattttcctccttaccacaattagaaattatatattttgctttactcttttgatgtctgtctgtctcagtagtatgacgcttcatgaaggcagtgatctcgctgtctttacacttctgtaccaacaataaaagctaacacatatttaatgcttgttatttcccaggcactattcccagcacgttgcatccactaactcatttaatacttaaccatacgaggaagataccatttattaatctagactaggctatcaaggcacagagagactaagtgcctggactccaattccatggctaatagagtagaagagacaggattttaattcacacaatctgcctccatgaaatcaatgtacactctgtgcattagacaaatttgattatttattttaggtaccttatactttctataagctgaggctttcagtagtgcttcctctgccaggaatgcttatatcttcttttccctggccatatgctatctctctttctagttttcatccactcttcatctcctttccaaggcttttatgatatccccctccttccctgcccagactaaatagaagcttctctttgcctaacctctttgcttccatatgatagtttagcaattattatgctatattttaattattaattttcttatatcccctagacactgaactcccaagatggggacagtgtcttttttttttaattcccagtgctcattatagtttatggcataaaaagttggtgctcaataatgtttggttaaatgaatgtgtgacacagaacatttcaacagcatactcattaatatcgtagaaatcttacctggttcaaaaaatactaagacatctgtccaagtagaaatcataaatccaataaacccaggataatagttttgaaggaagagagatgtaggtttagaaattgtcaacagccttatgtcactgaagagaagaataagaaagctgctgtctcaaccactgaatttaaactaagctgctttagacaaagaaactaattttaagtgagaatgaggaaggacaatgagcagaagttagaattagcagaaggattggagatagggtttgactttgtgtatatctgaatctttcactaataggcaaaatttataaatcattaatatctctgatatgagccatattttgttccttgaagcaattttctttttttaaccctataatgtcataaatttattttttttccttccaacttttcttttaggttcaggtggtacatgtgcaggtttgttgtgtgggtaaattgtgtgttgctggattttggtgtaaaaatgatttgtcacccaggtagtgagcttattaccctataggtagtttttcaatcctcaccctccaccctcaactaggccccagtgtctattgtccctctctttgtgtccatgtgtactcaatgtttagctcccagttataagaacatgtataatatttggtttactgttgctgtgttaatttgcttaggataatggcctccagctgcatccatgttgctacaaggatttgatttcaatctttttatggctgtgtggcgtttcatggtgtatatgtaccacattttctttatctagtccaccattgatggacatctagattgattccacgtctttgctattgtaaatggtattgcagttaacatatgagtgcgtgtgtgtttgcacacacattggtctgtcgtccacaatgatggactacataccgtcgtttgattgaacaatgttttttttcttttggatacacatacagtaatgagattgctgggctgaatgatagctctgagtttttttgagaaatcaccaaactgctttccacagtggctgaacttatttacattcctatcagtagtgtttaagcattcccttttctccacatcctcaacaatatctgttatttttttactttttggtaatagtcattctgatgggtgtgagatgttatttcattgtggtttggattttgcatttctctaatggttagtgatgttgagcattttttcatatgcttgttggccatatgtatgtctttttttgagaagtgtctgttcatatcctttgcccatttttcactgaggttgtttgatttttgcttgttgatttgtttaaattccttatagattctagatattagacctttgtcagatggatagtttgcaaatattttctgccattctgtagggtgtctgtttactctgtttatagaccttcaagtaattttccaaacatgcttcacaaaccttgaagtacgtgcaaatattttagatggacaaacagactatattaaaacattttccaagagattccttatctcattttgttgaatgtgagaaagcaagacgaagaggatttgtaacttgtgatacaaaatagggcacaatcaaatctaatctcacctgagatcttcacctcacctttgtcagcaaatagattctttcttttgcaccctgcactataagtattctgcatctattagttttcttatcagcatgaataaataattttacaacatagttcttgaattaacaaactattttgctccaaatacctatttcataatttctctttagttaaagtttgattctgttctttgtgacattcatagttctgaatttatatttttacttcttaagcaggggatttatattttttgtttcaaactagtggtattctttatctgatcaatttcagactgaaattagattggcgtaagtgaacaattaatttggatgttagtaatgggaaatttgagttctctgcgcagactggcagaacgtctcgttgggacatgatctgagagtaaaattttgcagtatggaaaatgactatgccttctgactatacttgtcagaagaaggtagcctacaactagccgaaaatggtcaaactaagatttatggaccaaacaaattaaaataccagtaaagggcactgaaatccattaagtgacttatccaagctaatgccagacaagacggcaaccaaagactaaaaataattatgtttagtgcaagctcttggcaaataaggagacaatatatctgcagttcaacaaaatcaatggattttgagtacctgcatatgttaggcattgtaattgataataggaatacaaagatgaaaatgtattttcctatttttatttcccatagtcttcattggaagacatttgtatttccaccttaaacttttatttttaagtagtgaaagcagagggactccattatgtagtagaaaacacaatggatgttctagattcaatttgtggagtcaatccgagtcttttttggagaagaacaacagaaatattttacattttttgccaagaagtataaagtgcatatttcaaatggctgttattgcaagaaagagtggattaatcatataagtattcaacaggcacttaaggagaccgattgtgttcagttaaataatttcacttctatagatgccaaatcactggattctataacacatggtaagaccagcatgatttgttaagtgacagagacaacttgaagagtgcaaagaacataccattgtcaaaagacttgaggtttagtatttcttcagtcattactcaatctttaggaacctcaattcatcttcttataacatggatatagtaatctgtatatcttggggctttggtagaaaccaaatgtaattatatacatcaaagaacattgtaatctgtaaaatattattcctgaaaagaatgcgcttaatgaagcatcataattgattacatatgattcttccttatccttaatttaactttcaaaatatcactcaatttgtcgttctcttctcagcccaaggaattaaatggtgaatttcaaataacctctaatggtcatctattttcaaagtagaatttatgattctgtgtgcccaattttgttttcttcccactatacctgggtgcctattgatactaacctagtttaagcacttatcacctcgtatttttaaatcttacaatcatatccttatcacttcaatttatctaaggtctctcttttcaaatcatccagcatgtaatctttaaaatgacttttccgaaacataatttttacaatattacggaaaatatttgttgtttgaagtcatacagacaaagctaagccctatgtcttactagttacaagacctttcttcttattcacttctctgtgaataatagtgtctgtctcctagggttgaattgagaacaaccaagtatatagtttgcacagtatctggattagagaaatgctccaattggacctctaccacctaatcctgactcactttataactgagtagtttatcgtcatccatgggataagtatgaaaatacaaactcctttgtgattccgtatactccaaaatgtttctagtcttctccatcaccgattcttttcctgctgaaaccattcgtttgcttatttatttatttatttatttaatggcgtacaacataatgttttgatatatgtgtttgttgtgaaatgattatatcaagctaattaatcaaatcctctatttcatccaaactgttttaattttctgaaatccctatactattcacttggtctcatggcctctacaatatcttgccctgtaattatgtgaatcctatcaagtattcaagtctgagcatttgctaaccttttttaataaacctgactactttcaactcaaactgctacttctaagtatcaaaaatatttactagatccttatcatttatatttttgtttatttccctctcttctttcctccctccccttcttctgccttcctttctgtccttccatctttcttactttcattacagatttcctttcaaaatgtatatcttatacgcatatctatgctatacgttcctgaagggtaaaaagagtctttacatctttccatgcacctatgacggagagatagggaccaatcaatagttgttaattgtctgtactatgggtttaacaaaaacacattaaaactaatatatgttaaaagttccaggccttaatttaagaaacttatttatattaatgcatgtaatctgcctgacaatcctataaagatgggcagactgaagctcagcgacattaggtaatttgcccgaggtcacacaggtcttaaattttataagcagtatgagaacccaagcacattcctgtcaaagcatatgctcttaactataaaggtacagtgatgcttttgcagttttggaaaaggatccttgtgactctgggtagcgttttcaaaagatggttgcctgtgtgtctatactcaaaatgccaatagtgattattatgaattcatttagcaatgattcatagagaactattctaggcactgggaatgatatgataaacgcagcagaacaggtggttaattttgtgaagctagttggtgagagatggacgctgagcacataaattagaaaatataaagtaatgatcagttctataaataaaataaaccatggatatggattggattaagttgagtttatactttgatttgtgtggtcagtaaagtcctctttgggtaagtgacttcttacctgagaccttatattaggaaaataattctagttagtataagcgcaaggagacttattaaaggcaattagatggcttactagaaaattaaacctggatgcttcttggaaaggatcagagtgccaggagccacacacctttcgtaaatatacccaaccacactaagaaacaacttagcactgatacttgtggttcccaagttacctcagtttcttgagatacttgaaatggagagattattagagtgatttcaattaagatggaaaggggggtaagttgtgttttgcatgtaaagcttactacagaatttctcaactggtggcagaacaggttaatgaaataccatgatactgatcatctcagcctttagggtaggacccagggcagcccaaattctcacgttcattaccttcagccttgagcagccctgtttccttcagtcttccatgccgtggaaaagactggggaccactagcctatagtattggcttaagaatgtgggatagagaagaatcaaagatgaattatgggtttttaacttgattgacttgttggctcatggtgccacttactagtaaggaaataggtagggcagagcaagttatagaggaaggggaataaaagggatttttttgtaaagatgtgaggtttatgaaatttagtctttaatatgtagatgtcaaataggtagatggctacataaaacgagttcaggagggcagttcaatttggagatctacatttcagagttattagcataaagatgtagtgtaggagcatgggactgaatgaaattactaagggagaaaacagaaaacaaagagaaatgattttaagactaaggccttgtgcacataaacattttgaagtagaacagactaatagtgtgctatatagtgtatgtacaatataggaagagaattcttgatgtgatatatattttaaaaactggaaaacatactgattacacaaaactaatgcatttctacatgtgtagttgaaagaaaaaacatagttgggaataatccagtaaattataaggaggactgaacatgttggggaagaaaactttcatactaggacaaacttttttttaagaaaaataactttttaaaaatgaagcctaagagaagatattatcaaagcttataaaatcaaaaattgtatgaatagggtcaacccattctttttttaaattattatactttaagttctagggtacatgtggaaccaacccaaatgttcatcagtgatagactggattaagaaaatgtggcacatatacaccatggaatactatgcagccataaaaaaggatgagttcatgtcctttgtagggacatggatgaagctggaaaccatcattctcagcaaacacattcttatttaccaaagtcaaaatactagaactagtgctttaaagcactccctgaggctttaaagaattactctgaggacaaaatgaaagtaaattctgttttaaccagtgggtagtaaacttaaaaaactctttaccataagcggtagaatgggttgaaaatataaatagtttcaaggtggagttcatggacaatagatacacaataggttgtttaaggaaatggaatattttaatgagtggtacatctccaatcttttaattttgatatcctattttataaccactttctgtaaaaaagattatttcaagccagagttggaatagaagggatataatctgatataatatgaatttttgttctgttagcaaacatttttaaagtgaatgttctgaatagattccaattttcttaaaatagttattatgccttatgaagacctgcaatatccgtgtaagaagagcaatgctttttatatgttgtaataagtaatttattagaacatttattcacaatgatgaatcaccttaattaatatggtgagggcaaaataatttctgctatcaaatatcagtatgtacttgcaaaattcttataaacttcagttcatatgtctgtttttctttaaaatatccctaattactgacctaattttattcattttgccatttaatttatttataacgccattcttttcttctaatgcgttctcctgtttgaataatcatgttctctttattctctttttcgtctttctactggttggggaattatatattctatatacattttctgagcccttatccttaaatttatatcattcataattaatgacattctagtctaaacatcgcaagagcagtagaatgtttaaattctgatttccctcctaccatatttcatgttattgttgcctgatattttgctcctatacattgttacccctcccattagtcattttttatggtagtaaaatatttataatactattttcttcttatgagttctgattcttctttctggttcaaatttcctccttccccatgtacacatgttaacaagtacctttgtaaatctatatttcattcttacccttgaataacagttcagcaggggccgggcgcagtggctcttgcctgtaatcccaacactttaggaggctgaggcgggcggatcacttcacttgaggccaggagttcaagaccatactggccaacatggtaaaatcccgtctctactgaaaacacaaaaattagccgtgggtggtggcgcacacctgtaatcccagcgactcgggaggctgaggcatgagaattgcttgaacctgagagacagaggttgcagtgagctgagatttcactactgcatcccggcctgggcgacagagtgagactccgtctcgaaacaaaattaaaagttcagcaaggcattgtattctatatataatattctttgtgtaattatcttttgaggataatgcatcttttctttttgctgctcttaagattttgtctttcatgttctgtatttccataactatgtgttctgagtatttatacattggaacttggtatgcatcttcaagtgaggactcttgtgtttctatgattctggaacattgtctaccattatcatttcaaatattgtttcccagattctctctagtcactttttctctgattccactgtatgtgcattgaatattctcctttcatactaccacgtattttaatttctctttacatatcttctaattcactaattctctagttcaatctaatctatggttcatcacatattttgagagctttgctaaattccttaatttgtttttggaatttatgtttggttattttcaaatatatgtgttttatatgtcctctttttgttttctattttctatttttatttctctggccatttgaatcatatacacatcatgaataaaaagaaaaacaaattgttctattagtaatagttttattttgctgtccgtaaaatcaaaatacgatgagaagccatatgacagtaagatggaaaaaacatagggaagaatgagaaaatttaaaaaatagagtaagtggatggatttgaagtagcaccttatttctctttcttgcatttgggtttgcccatttttaaaaacaatccccatcccttttaccacagtatttccatgtgtttggaaaaaaagaggaaaggtttttgtgggtatatggtgaaggagtactcctacaatttcttaggactgtatgttcaacaaaatttgtttttaaatttgatggaacaaaccttttcacaaaataatattaatataaatataaaatgactgattcatgaattaccaacaaacaacttgaatttacaaaataaaccttcaaatgtatttttcccttgaatagtattttatttatatttttaattgacatgttataattgtacatatttatgaagtatcttttgatatttgaatacatgtatacattgtgtaatgttcaaatcaatgtacttagcatatccataacctcggggatttatcatttctttgtagcaagaacattacaaaccttcttctagctattttgtaatatacagtaccttactcttaaccatattcaccctactgtgcaatatgataccatattcctcttaccaaatagtaactttgcactcattgaccaacttctctccttcctcccctccctgctctctgttaatcactgttctatatctcaatgagatcaacttttaaaaaacccacatgaatgagatcatgcagtatttttcagtgtgcctggcatactcagcattatgtccttcaggtttgtccactttgtctcaaatgacaggatatcatcccttgttatggttaaatagtattcgattctgtagatataccacattttctttatccattcatctgttgttaggcattttggttgattcccagtcttggctgttgtggatagtgctacagtaaacaggagtgcagatatctctttgacgtactcatttcagttcctttggatgtatatacccaatagtgggatgactggatcctatggtagttttatttttaattttttcatgaaccttcatactgtttttcataatgggtgtaccaatttacagtcccactaacattttgtaaaagctcccttttctccaaatgctcaccaacacttcttttcttttgtctttttgataatagccattctaataggagtgagatggtatgtcgttgaggttgatttgcatttctctaatgattagtgatgttgagcatttttttcatacacttgttggccatttgtatgtcttcttttgaaaaatgtctattaaggtattttgcccattttaaaatcaggttatttggtttttgctgttaagttcttatatattctggatattaactccttgccagatatatagtttgcaaatatttcctcccattttgtaggttgtctcttcactcttgtttctttgggtttgcaaaatcttttttgtttgatgtaattccatttgtctatttttgcttttgctgcctatatttttaagttcttatctaaaaaaaaatttgctcagcccaatgttgtgaatcatttcccctatgttttcttctagtagtttcatggtttgggattttacatttaagtcattcatccaaaaaaaagaaagaaaaaaaaagaaaaaaaaagaaaattaatcactttctacatttttttttttttgagatggagtcttactctgttacccaggctggagtgcagtgacacgatctctgcttactgcaacctccgtctcccaggttcaagcaattctcctgcctcagcctccctagtagctgggattacaggcatgtgtcaccacccctggctaatttttgtatttttattagagagggggtttcactgtgttggccaggctggtctcaaactcaacctcaagtgatccatctgcctcagcctcccgaagtgctggaattacagatctacattgtatcttgatggcagtataactattattttttaaatttttggatttttaggcatcttatgtattatacaatgcctttacttaaaagtggaaaaataaggtgaacatattttgtgacttgtcccaggtaccattgtttataaatagcactaaaactaaaatgactgaattagtcactccttgtttttgtcattgctctaagtatgtgttttcttccatttatagtatgagataactcagccattttcattaaatgtcagaaaaaattttatatagatctttacacagcatgctaattttaatagttatatttatatcatatttggagtattagctttcatcatagtcctttgttatgttactcatatttttcttgatactgaatgatggaatgagtcatttctatacacttagtattaacctttcagtagttaaagaagtggcatttatttttaggacccacacaactgtttctgaacttgtaaggaaaagccatacattttttctttagttcaaataactttacatcctaatatgtatatttggttgataagtatattgattaggacaaatcagtttggaaatagttatatatgtaagaggatacttatcaggaagtgagccaaaaatgtttgtcagtagtactggttaaatattgaaattatatttcttaatttgtcagtctgtaagtgtgagcacaatgtcttagcacttgggataatttagaagcaactctggctctagattacctagcggatttctcaacgctggctgtagactttaattcaaccgtgattctgtattacgttatataataggacactatttccacaggcctatgaattttttataaatttggaatcttcactttttcattgtttttattttacctacttaatcttttttgtagtatgttttattctcccagagatcttttgactcttaaatatttatagagcttttgcactacctcagaatatcattagcaatatgatagctgttacttctgaatacttttctttttaactttcttttaataatcttccataaaagtcttctttgcatgtatgtttaatctattaattaacttctagagtctgctacttaaataggtgctatctttcttctgtccaaacttgtatagtaattaaaaccagcagtgtgtagtagaagacattttgcataccatcaatttccgaaaaatttccaaatattatggtttctagtcatatgtctacaagtttatgttttgtaattaaattcttcccttaaaatgtttatgtaaaaaaagttggtctttccttttttagtcataaatatttgatttccagtttttcataagtaatatatacatttatttctacttcagcagatactccattataatcaatgttgctacagcagtagataaaatacaagctccatgagagcagagatcatgtcagtcttcggtagttgctgcaaaaccagttttgagtaactatctttgacaaataaatgaaagaataagtttgatttcaatgtacatcttcaaaataatatctaaatgaaattcatctgtgcaggcctaaccctgtttgagtccagctgcaaatgtacaagtggtttttttttggtatagtagagtggaaagggtgaaagctttcaagctaggcaagtcttgtttcaaatcctagtgttgctgtgtaatcgctgtgtgaccttaggtatatcccttaacttctctaagccaaagtttcttaatagaaaacttgtgatggttttaacaattatgaaaaattgcattgctgaaagaagatgctcagtatatatcattgtattttacactgtgagataatgggatccacataaactggcatgcacatttttaaaataacttttatttttaaaaaatgggctttagaaattgttcaattacctaatgttctaatgcatttttaacattctctccattttcttttatttctgctatttttatttccatattccagtttatttgcgcaacttatgtctgaagcataagcaaagattcttccccagcttctcctcttattttacatcttcagttctacaataatactgtattagtcagggattggtcacaaaaagacgagctgctctatagatttcaagcagtgaagagatttaatacaaagaattaagtgctttactgaacccctggaaaggctgggagaataggattcaggtgacgatgccactagctctccacttagctacaatgttcagaaaatgagcaaattgtgcagaccacaggaaaccactagcagttttcactactgcttgtgttatcaaagcaggtgatgtttaggaagtacccagtggccactgtaaaattctcatgtctgcagaaatccaaacctctgcttctcacccccaggggaagccctaataaattttcagcctctccttagcttgcaaatctggtacaaggtttgggaaaaggtgattgatgcccaggcttccagcccctatgataacagaggagagcatggcaggtggaatgatactgagatgccaacagagaagctggtacagcttcacctgtatatgactgttcattttcattccaatttcaggcatactctctattttcagttctgatccctatgcctcctattattgcaataattattacttaataaataaatggctccaattgcagaaagaggtttacttatgtttagcatacatactactctctcttaggcatctttatatttcatttatctcagaaacttatcctttttacaaacaagtctgtagactataggtaggcaaactatgacgcagaaacgaagtccccgaggctgcctatttgtgcagataaagcttacctggaaagcagcaacacccatttgtttccacattgttagtggctgctttcacaccaccacagcagcatggaatatttgcaacagaggccatatggcacacaaagcctaaagtatttaccatctggccctttatagaaaaaagttgctgacccctactatggatattatgtaaagaaaggaactactacaggtagatttttctcacgtgcttgcctattgaatttctttcataattgatttaatgaatataggctttttatcttatgggaaaatatcatcatactgcacgtacttgtgtgggactctgtcagtgatcttaaaaataaaaatgtcatgcacccaagagaaaagtattcattcaaccaagccaatgaataggttccgaatcttcctcctgcactaggcattgtgatttcacctacatttccaaacatctgatttttaataatgcatcgtataatcttgattctcacatgcttcacaggacagccgaattctttttcaaaacttatagtcactgttgagtcataccaatgatctttgctttctagtagcttccatatcttaataacatttttaaaatatgatacaatagtaggtctattttactcccagtaattaggccttgaatcttattagcaacttgatcatgctggtcactattgagccatgaaggcaatttatgaaataaaaggcttttcattctttgccaaccaatgattcacccacatcttttcccctatcctcctgtatcttttgtatttttttctgctgtgaagtcatttttttaagacgggaaggctggcagggagggaaggaaggagggagggagagagagagagagagagagacagagaaagagagaacgagaacacaccctaaaaggttttcttattaactattctcaagtattatttcttatcagctatcatcagctatttcttcttcagcatcatcttcaggtatttttttttaatcttgtaaaacagaacacttttttctcacacattgtaacttctcccgaggtagtcctttattcttgtatgacctcctcctttgctcatcaccttgggtcttattctgcatacttctctcacttgctctttgatttctactcttcttgctccaattcttacaatttcttaacctctattttaaaaaatcttttctcttcatcattaaatgcttttacagatggaaacattcattttgttctttaaggcatttcaatatttttcttcccttgagtacatttcttatgccattttaacttgctcctttaccatctgaaatcttgaaaggggaatagttcattcttcctcttgaatatatattttcattgaattttcttcctgttaaacaagaatttatgcctgtcaatgcttttgataaaaataccaatttttttgagaaattaatttaactgtaaccaagatgtgggctttcagtttgtattctaccatgtctatgttcacctgcacataaatctattaattctggggaccattcccatccatctctgtttttattataattctgatagcaagcatctaaatatacaatctcaaattctatattcttaccagtgtatgtaagtgtatgtattgtgtgcatgtattgtgtaagtgtatgtattgtgaccacggataacttccagttacttccaacattttcatctttttctggaacaacgttggaaatccctttcaagacagaaaattccttcgtgaatgaagcacggatataaaatgcttcccctctttgtttctttggatgtagggtagctacatatataaatgtgataggccctaattcctaatttatttctttgattacatattttccagtgcaaagcatagattattaaatatctgcacaaataaaaattcatgttcacatttttttgttttgtttttttttgagatagagtttcactcttgtcgcccaggctggagtgcaacggcacgatcttggctcaccgcaacctctgcctcccgggttcaagcgattctcctgcctcagcctcccaagtagctgggattacaggtgcctgccaccacgcccagctaacttttttgtatttttagtagagatggggtttcaccatgttggtcaggctggtctcaaactcctgacctcaggtaatccacccgccttggcctcccaaagtgctgggattataggcatgagccaccacacttggcctcatgttcacatttttatcccatttatccatgtgaaattagctctaaatgtgataaccactagccacatgtggctgtgtaactttgaattaattaaaattaagtaaaatttaagatttagtttttcaactgcactagttacattccaagtgttcaatggtagcatgaggctaggagcttccaccttggatagtgcagatagagatcattttcattattgcagaactctctactggacactaaatattagaaaacatacatagttccttcatttgtaacacatctctccctatcacattaagctctcttctttgtatgaagagtgtgtaaatttgattcatttcatgtcggaatccatgggttgtacttctaaactttagtggtaatttacactttgtattatgtactcctatttctgatttcattttttcccattgtttgtcatttaattcagccaaattttcttttcttgcattctcctattctatgtattccttagatcagtggttctcaaattttaatgagcatcaaaattacttggagggtttgctgaacacatattgaagggcttaccctgagaatttctgattcagagagtctaggatttggccgagtaatttgcacttctgttattgctactcgttctgggggctcctaccctaagaaccactgcctagggaaggcttctacctctctttgcccacttttctatgcacagagctattttttatacaccctgcttcagtattttctatacagcttatttatttcttcctctatttatttaatcattatgtatttcccccataacttgaaatccatctctcttaactctacctgtctccccataccctttctgtctgtgttctctcttttcccttgcttctccaggagactttcaagatttcatttttacagacgtttcttgttctgtttccttttgctcttgcatgctggctcttgaagatggcccaactatgccttccttcctttcactataatgtgtccttggcatttaatttttattttactagtggctctcttctcagtaggcactgtggtatcactgcactccagactgaaaccacatttcctaactgtgtcctatacttaagtgacctgggaagtgacagttatatcatgtctttagctgtcttctgtgtagaagcaataatatttctctgtaacttactgagaatctctcagcaggtggtcagcacgctcaccattttgtcacctctcttgttaaaaattgctttttgcagctcaattctccaaatgtcccaacctctactggactggctcatacttaatcactttttcaaaacggtgtcacagtatgtttattttgtttctaaagctttgactcttttccttcttgtacagtctcaaaataagtttccatttttctgtttaattggaacttacatcaaacttcttacttcccagcatttgaactgctgcatgatgtgtaccctggatccattccaaattgaattaataagcagacctcaattttatctcttgctagactgtaactctcatcccctgttaagcaactcttcagtaacagcctagtattgttaaagggggggcctcttgagttagaacaacccttttcacattccacctctgcttctcatttttctcacctacacaatgggctaatattagcatctatcttatagaatcattgagaagaacaaatgaaagaaggtactttgcacaatgcctggattatggtaaatcttaaatcttggcctttactaatgttgctatattaatcacagtttcccatgaaggaagttatttctttctttatccttcaatttctttaccttgcagtagatgcaaaaaatttgcaataaatattttccagatctttattctacttctctactagcttttgccttttcctctaagttgcctatcccaactttgaaagtctttacctctgtttctcatttgcagttgaacactgacacaaaacaagagaaaacaacaagcgaataagaacacaaacacaacatcatctcagcactttctctcactgtgccaaatgttcttaaaggtttgttagttttttatcaaatcacagcttgatttatttccagcctgtgctccacaccagttgactactgttatctttgtagtaaccaagcaaaacaagtagggcaggaactactgtgcctcttgtgcagacttggaaagtgaggccacaatgacagatgtgacttagcaaggatggtgcagccatgtagtgtaaacagggctgctgttctaggctgtgaaggtggtgcaccgcagcaggacaccacagttaaagggatacctccaccttgaagacatcactgatttgttttttatagtaaggcagtttccagcactgtcatggagagaggctcctatttccaatttgcccaaaggtgctatgtgggctctcattagccaagaaaactcaactcaacacatgtgctctgctttatagcttatttactctttagtcgacgttccatacaacatagattactatgtttccttttctaattcattttatcctgttattttctttatcactctccccctctaccctgcaacaacccatttacttttcactttactatataggaaaagtaagcattaaaattcagttggacgataaggtgaaagcatgtaaagctgttgaaaagccaggtgaccattattacatgtgactacattctagactaagtgggatgactaatatattttaaatgggaagaaataatttagatagctttatttgctaatgtgagataaatagattaaagttgaaagccactcaggctattgcaaatattatagcaggagaccataagaccctgagtaggcataccacaaagtaataatgtagatgattggctttggataagaggcccagtgaggaagctaattgcagaagcttgtagttgattagttataagatgacaaggggaataaaagcaagagtttctgagtctagataaccaggatgatgatggtgccatagagagaaatggaaaaatacagagaaagaacagatttcagaggaagaaaatattttatttgaagagaggagtggtgttctggtaaaaatgtcctctaggtgatagaaaaatgtgacaggaaattagaggtaaattagaggtggagaaaaacattacatgtagttgaatagagctacttttgaaagatatcaaaggtattcagttctcaatggccaaaagagggaagctgccattgttaaggttccacagcgtaggggatctcctgcaggtaagaaatagaagaaggatgaagagcaagcacatgatttagagacagaggttctcaagaaaaaaagggatgctcagcattgtagaatgcttcttataaattaaaatgaagactggtaaaacctattctttttttctggtgatttgttacaatttaaaaaaattgtatcttccttttactatcagtgaaaattcccatgatagcttcccattttggaggcacccaccaaaaatgtccttttatatatctccttcagtcttagatttccaaattccctttttctgtaacctgacctctttctatgaaatacaaaagtttgatttaaaagatgcctttcacactccataaaatagtatacattgtcctggctgggtgcagcggctcacgcctgtaatcccagcactttgggaggccgaggagggcagatcacctaaggtcaggcgttcaagaccagcctggccaatatggcaaaaccctatttctactaaaaataccaaaaattagctgggtgtggtggtgggcacctgtaatcccagctactcaggaagctgaggcaggagaatcgcttgatcccgggaggcggaagttgcagtgaggtgagatcacgccattgcactccagcctgggcagcaagagtgaaactccatctcaaaaaaaaaaaataataataatatacgttgtccttatccaataacgtggagttttttggtttttaaagcaacacagagattcattagcacctcattagttcttgaagggaaggagctctgaatgcaatactatctgtcttccattaaaaatggaagacatcattcccataagttgggaaaatttgagatttaataagaataacaactacagtgaattgagacacatcaaatatttaaaaactgatgattttataaacatactaatcaaggaaacattgttagtttacagcattgcagcatactaggatcccgactcattattctgcaaagagacaaataaagggaaggaagcatacatttggcctgccttttttcgtaccaactgtacgtattttaggataatcacattggaaatacataaatattatttttgaagtatagtttcagctaataaatgcaggaaagaatatcacccttttgcagcccataataaaatggtacgaaatgatcaccaagcctttggctcaaaggttggtggagatgcttgagtatggaaggattagggtgaaacctcctgaaccactgctaaatcttggtgtcactaaagtgtaacaaccagaaatcaggaattacgtgagttcttgtacctaggaagtatttttgcctaattttaaaaaaagacaaatatcctctaaatcatgcatgcctgttttcattagctactttacctgactttttcatgaggaattaaaaaagttattcttctgtacttttaggactcaaattgataaaagaaaaaagtttttaattttttaaatacttcgttccctttgtcgacatgtagaatgtgagatatgagatcacactgaggaaaagagaagccagcttcatgtggctttctgaaaatatgatattattatgtgaataataattattatttagtgaaaaggtaaacaaaaatgctttgtttatatgctattagtgcaaccaaatatttgtgtcagaaatgattaataattggaaactgacagaataactggcatatgaactcttaggtctattatctagccctaactctccttgatttttattgaataatacaacaatgcttaaataatcacaaaaatgaataggaaacaggggtcattgacaatttgtaggtcaaccaaacaaatgtcttagctgtagaacattttacaatccaatagagaacaaactttatcttagattagtgaatgccaaagtgactattctttcatcagggccaaggtggcactaacactttattagcccatatggatgggtctcaaaagcagtaatatagaaactttgcagcttagctgtataagaataatgcttataaataaaataccataacgtgtaaaagtaaaaatgtctctcttctttttaaatatacttcagtctattcaagacaaagaagtagccaagaaacataagaaaaaaatgctcaacatcactgatcatcagagaaatgtaaatcaaaaccaccataagacaccacctcacattatccagaatagctattattaaaaagtcaaaaaagattggctgggcgcggtggctcatgcctgtaatcccagcactttgggaggccgaggtgggtggatcatgaggtcaggagttcaagaccagcctgaccaatatggtgaaaccccatctctactaaaaatacaaacattagccgggcatggtggcgtgcggttatagtcccagctacttaggaggctgaggtgggagaattgcttgaacctgggggggcagaggttgtagtgagctgagatcccaccactgcactccagcctgggcaacagagcgagactccttctcaaaaaaaaaaaaaagtcaaaaaagaacagatgctggtgaggctgtggggaaaagagaacacttacacactgttggtgggagtgtaaattatttcaggcattgtgggagcagcttggagatttctccaagaatttaaaacagaactatcattcaacccagaaatcccactactgggtatataccgagaggaaaataaatcattctaccaaaaatacacatgctctcatatgttcatcacagcactgttcactgttgatatgcccattaatggtggatttgacaaagaaattgtggtacatatacactgtggaatactatggagccataaaaaagaatgaaatcatttctttacagcagcttgggtgcagctagaggccatcatcctaagtgaattcacacaggaacagaaaaccaaatgccacatatactaacttataaggggaagcaaaacgttgtgtatttataaacataaagatgggaacagtaggcactggggattactagaggaataagggaaagagcggggcaagagctggaaaactacctgttgggtaccatccccactacctgggagatgagatcatttgtactagaaaccccagagtcatgcaatgtgctcatgtaacaaacttgcacatgtacccccgaatctaaaattcatacaaataaataagtaaacttcgatatattcagaagaaacacagatacctgcttataatttaaaatagaaattttgagaaaagaaaaaacggagatagttttatcagttcttaacagtgtagtcataagagtcagtcatacctgggtttgaatcctggctctccggcttactaacaagttaccttacatctctaaacctgtttcgctatctataatatgagtctaataatagcaccaacccttagacaggtgtcagaatagatgagaaaatttatgtaaacagcttagcatagcgcctaacagattgtgatacttaataaatagtaactatcatgattagtatctgtcatcataatgaattccagatgaattaaaaatttagatctgaaatgttaaaatataccaaaatccagaaggaaatatatgattttcaattgctgatctataaatagaagagaacattataaatgatgaaagacattataaaaaaagaacataaaacaatgactaactggaaatataattgccatgaaaagtaacacatttaatatccttagtgtataataaaattttacaattaagtaggaaaatgtaaatcaaaataggaataaaagggcatgaatttaaaaattttatgacacgcatacatccacaaaggaaaagacaaaagaaatgcaaaaggctgcatggcgttcagaaaaggattagtataaagaagaaaaaagaagtaacgttatctgcaatcttacctcttattaataatcactgtttaaacttggtagagtctctttcagacatatccacatgcatgtgtaaatacatacatacacgggcacacacacactttgcatcctatctgcattttgcttcatgtttttccattattccatggtaattttttcatgcctaagaacagtctttaaagtgttttatttggctctgtagagtattagtatgtcaatcaggtctctagttgaaggttcctgaaactcaacttgaactagattgtatatatataaaatctaatacgcacgcgcgcgcacacacacacacacacacacacacacacacacacacagagagagagagagagagagagagagagaagcttgtttcacgtaaccaaagcagaggaaagacttgatggaattacagaaatgaggtatttttacaccattaataatcactttgatttggcttagctttttatgccagctttacatttttaggcaagttttctctggtatgtcagggaacattgacacaaataactccaagctagtatctccatgtctccaaattcagagaaaagatgaacaggtctgcccttctaactctaattaggggaactccagggaagacctctgttggatatttgggtcatctgcttattcctggagcagttatgtggccaggggcataggataagtagcctagactcttatcaatccagagatgagttaggagaggctgttatgagaagaggatggacaggtgctgagcagccgaaaacaatgattgccacgatatgaatgtcccacaatttattcagtgttttgtacgttaatggatacttaagtttctctaccatttgatcttataattaatgttatgataattgtcgtcatgcatgcggctttgttgaaatttttattggttttctcttgtaggataatttactagaattgaaattattttatgcaatcccatgtagctatgaatacatagagtcacatctttcatgtacttaacctgtataaattcaattatgttgaatcagaaatacagggtagagaaattaagaaaacagtagtggagatagagtgagtgagaggaccagtgagaagaataaaaactagttgaatagctcagccgtacttacctcagaatcaatgaccttatgcttagagggagcagcatgaactaggagtctctagtcctatgttatgtcagtttttctcaatgttggcctgcttcttgtagagtgagattgtgcctagctgagtttcattctagtggtaagagttagattttctttttttgtatgccatggactccaaacacatggcaacccttaatctagtattcctccaaagaaaacagcaatctgttcaacaccagaggaaaatctgacgggcttgtacttaccaagtcattatattatattttgtgtgtatgtgtgtgtgtatgatttagtgatatctcaaggataattttgagtatgccctattttcatatttcataccaattctaaagcctaccccacaggaacttgaaactctgctcaattgctaaattaccattaccaaataatttatgtcaatttaaactcctaccataggatatgtacaggcacatttcacctcatccttgcctgttctgggttaaagcactttagagttaatgggaagaaagaaaaataattatttaatataaataacaaatacagaggtggtcagccacatttcattttaatgaaatggggccacgagaattccagtaaatcacaattctacttctataaataaatggaaaagaaaatagctaatcttgtcgcacctggaagcctcaaacctaagataacaacaaagctgattatttttatagtgatcagatcttaagaaatacaccagcatcttatgatgctatgctagaattattttaaaaaacatacagccggatgcagtggctcacgcctgtaatcctggcactttgggaggctgaggtgggcagatcacctgaggtcaggagtttgagaccagcctggccaatatggtgaaacacgtaaaaatacagcaagggatttattctacaacattaagattttcaatttaacagacatattctatgtgtacatatttgcatgatactagcactgagcaatactcttctgttaattcaagttactctgaatttaaatccccagacttccagaatattaagtctgcttatgatcagtgatcatttattaacttttttgcattgtattttagataatttcacagttgtaaagaatttcataggttattgcataaaattcatgcttttgaatataaacacacatgcacgcaaacacacacacacacacacatatcccccatgctcacgtatgtttattgagacacttttcacaatagcaaagactcggaaccaacccaaatgtccatcaatgatagactggattaagaaaatgtggcacatatacagcatggaatactatgcagccataaaaaaggatgagttcatgtcctttgtagggacatggatgaagttggaaaccatcattctcagcaaactatcacaaggacaaaaaaccgaacaccacatgttctcactcataggtgggaattgaacaatgacaacacttggacacaggaaggggaacatcacacactggggcctgttgtggggtgggggtggggggtagggaaagcattaggagatatacctaatgtaaatgatgagttaatgggtgcagcacaccaacatggcacatgtatacatatgtaagaaacctgcacgttgtgcacatgtaccttggaacttaaagtataaaaaaaaaattcttaggttgtgtgccttgcaaaaaagtcagtgggctagatttggctcatgggctattgtttgcttacccctgccctaagtcatagtttccaatgattttaaaattataaaaattataatcatataaattatgttggattgatcatatactgataatttaatgatctttatgaaaaaatttaaggtaatttgatacaattctttaagttacagaagaaaatgatatcatgagcgaaatgaaaaaaatgggataaaatagctaatggtgacaatacttttttggtatactatctggtatttatctttatttaatctttggataatatgtacattcctaagatgaaaatgagaatgtaatttgaccatttgaaaatatatattcttacactgacttaaaaagataaagtattgataatttcacatcatctctgtctttgcattaaaaagtatcatggaacaatagccacactttttggaaattcaagattccataaaatatagtttgaaaaacacatggacgtgtttattaatttctcctttcaatattctttctgggcatactggaggaaaattgacatgaagaatctttaaatttgttatgaaaagtagaaggtggcatgtaggcaaaactttcccctctgagagtgtttctgcattatttctttgcatgggaagatctcaccaccaaagtgtagcatgtctgtacccaataggaaaatgcataccctgatattcattttaatgaaaaatttcaatgacgtataatcctttgtcattctttcccaaattgaccctctgatggggtaagaaaaaaatgaattctacctttttcatagatagtaaccatagaaagctctggtttctagagagattcaatcctttaaaaaggaacataaagagaaaagggatttggagagaaattaattctaagactctagacctgcatgtctgtgtaacccaaattctagcaatatctagaaaatagaaatcaaatcaactaggaactggtaatacaattgctaagacttcctttatcttaggtccagcagattcaaatgacacactctttaaaaaaaaaaattattatttttagtttttgtgggtacctggcaggtgtatatattttggggatatatgagatgttctgatacagacatgcaatgtgaaataatcaaatcatggagaatagggtatccgtcccctcaagcatttattttttgtgttaaaaataatccaattacactcttttagttgttttaaaatgtacaattaagttattattgagtatagccaccctgttgtgctatcacatagtggtcttattcattctttctatttttttgtacccattaaccatcctcctctcctcccgcatcccccattacccttcccagcctctggtaaccatccttctactctccatgtccatgagttcaattgttttgatttctagatcccacaaataagtgagaacattcaatgtttgtctttctgtgcctggcttatttcactcaacataatgaccttcagttccatccatgttgttgcaaatgacaagatctctttttttttatggctgaatagtagttcattgtgtatatataccacattttctttatccattcatctgttgatggacgcttcagttgctttcaaatcttagctattgtgaccagtactgcaacaaacataggaatgtagatatccctttgatatactgatttcctttcttttgggtatatacccagcagtgggattgctggatcatatggtatctctatttttagtttttttaggaacctccaaactattctccttagtggttgtactaatttacatttccaacagtgtataaagggtccccttttctccacatccttgccagcatttgttattacctatcttttggatataagccattttaactgaggttagatgatacctcattgtagttttgatttcaggtgacacatgcttgactttagtatgaaagtgtcattgacattggctgtctagtcagtgtctaatagccttttctctatctttgtcataaaatctatcatcatctgtggtctactttgactcttttttttaatgacccctgagatagttgatatggaaaatacataaatagttgaataattgtatgaacttttcagtgtcttctcaggtgacctaccagaggagaagtagggtatagaatgacaactttttaattagggattttttttcccttaagaaacagctatggaataatggaaggaacctaggttttagattttacatatacacacacaaacatacacacatgtgtgtgtatgtgcatgtgcgtgtgtgtctgtgtatttatatatatatttgaaatccatttattccacctctcaatcttatctgagcctgggggatgtgtgtgtgtgtgtgtgtgtgtgtgtgtgcatgcacatgtgtgttcatattcaaaagctaagcatgaattttatgcaataacctgtgaaattctttacaactctgaaattatctaaaatacaatgcaaaaaagttaagtgatcactgatcataagcagactgttgctattctggaagtctggggatttaaattcagagtaaccttgaattaacagaagagtattactcagtgctagtatcatgcaaatatgtacacatagaatatgtctgttaaattgaaaatcttaatgttgtggaataaatcccttgctgtatttttacgtgttgtatttataaagatataatgggctctaatttttagagagtcctgagaagtccatgaatattaaacacatcgtgtggatttttatttatcatcatctctgattttatgttcgtgaaattataactcagtttcgttggagttctaactacaggcctagttcaacaaaattctgatttccatcatcttgactacattgattttgtgcactttgatctttactttgtattatataaaagtcaatatgttgatctataaacacatctgctgcttggatagtagttattttagaattggctctctttccaagcacagttatgacactgagaattggtactgtatgctccagtcagcacttcccagtcacaaaccttatgaagaatttaaagaactatgtggaggaaatactctttgttctaattcaacattagtgtatagattgtgtttgtgaaaaactgtatgagaaactggtctttttaaaaatgtttttccttcagttctggagtgtcaatatcaattttattctgtgattagaaatcgcatgactacagcctgtgtgtcaaatcattaattcattgaaattcctaatcaatgtaatattgcttttaggataaagttttagtaacttactgagtgggctctctctgtctctctctctctctgtttctctctctctctctctctctctctgtctctctctctctctctctctctctctatatatatatatatatatatatacacacactatatatatacagacattatatatataatgtgtgtgtgtatatatatatatatatatatatatatggcagtctaactataagagctatactttttagtgtaaaaaggttgtatattcgtgcattggatggatacctaaagctgagaggttagccctacaaagtattaaaaaacaactcaagaagtaagaaatcaagaaatgatcaagagttccatagctagttaaaacaaatcagcagtctcaaatgagttcgagtgtgaagtgaaataccacaaagatgaattattttagacctgatgtgaaaagaaatgatggtgtaagaatatgagttacagcttacacctatatgtgtgtgtgtttgtgtgtatgtgtgtgtgtgtgtatgagtatatatatatgagattatatgggaaaaagctaaagagtatatatggaaaaagtactttccagctatacatgggaaaaacaatacatgggaaaaagttataaggagttttagtttagcataagtgttctagttatctattgatatataacatagaacataaaatgtcacttttgttacattttactgaaaaggtaagacaaaagggcagccagtgttcaagaggaagggaggaatagaccccaactctcaatgaaggaatgacatgcacatatggaagggattgaattgttgaaccatattggagacagctatctaagaagtaaatattatttaatgatacttttgtatattggatatcactatcatgacaaggacatattgaaaatagtttacctgggtaattttactctcatctacttaattaaagtaatacatatagattttgtccattcatttgatgacagagagtatgacacagtgagtatgtccttttgggtttcaaattgatgaagcaggcagacctgttatcattctggggacgcttcccagtttggaggttctgagtgcaagagggcattaggaagacagagttccctactgctgctgcatctgctcattgcagtatgggattgggtctaaaattctatgactttgaggaatattaccagattatataattttaaacattccaagaaggaattgtagtgatcttcttgtccaattgttttatcaaaaagatacgaatactaaagcccagagaagttgacctcacaaagatcttaatgtatgagctatatagactctgaatctaagtcttttaactgctgagttactactcttattattccatatattgacactgctttccaaaagtctgtggtgtaattatcaatctggcaatccatgtaggaggactgttttcaccaaacggtgaataaaactttgttatttcattatattttcatgttttgggatctctaacagagtgaaaatgtttagtcaacttgaaagaagtatggtagtgagtaatttaagtgcatatggtgagctggggaggatctagttttgatgggccctgaagcttttacaagtttggctctactctgtaagaagaaaggatgtaaaattacaactgcaaaataagtacatggctttaaaagaggcctgtgtagtttaagaaccctcaagctcaagcttcatcagtctctgtggttgagttgattagtttaattgaaatactagagtttgggaaggacttaagaacaaggtgttatttcttcaaatcgttgtcgcctttgaaaagggtaaccttttttctggacttaaagtgctatccttccaacgtgtataatagtttttaaatgcaatcttgctgacatgtgtcaacatatgcaaagaaattgagaatactttctagctcttagtggtatgatactgccttgcataatgatttagacatgcagctctgccttttgtatatctccagccaccaacatttaggtaggaagcaagtactattgatctttgaaaactaaagaattgtgaatgatgcatttgattggtatgttaaagctatcctttgtatgcatatttttgtaagtcgttgaaatacagattatttgacctcaatttctccatctacaatatgaggatcaatgaggatattatatcatgtctgttgaaaatggttggatataagtggaggccagtggaagtattcagtgaaatgatgcatttccaaaatattgttttccagccaatgtccagtgttagtattccacacatggaatgcatgataggtatagagaaaataagggtagtattttacatcacagagtattttgagataggcaagaccattattatgtttgccattcttgtgaagaaaatcagttgcaggatattaacttatttaccttaagtaacatagctgggagtcaagcccaagacttaggacacaaagggcagcaggctttttaatcatcccactctgtctctttgagaggccaatagaagtttctaccatctccactgtcataccccacctggaaacgattgcattctcaaagtcttgtaatttagcttttcattatgactgcttttctctgtgttacttaattagaatctgcagcttttggcaggaaaatagtcaaccaagcagatttctaataagcaatgtctttaggggagaaagtcgaagtgagcaaagagaagagaatgaatgcgtgatagtagctgctagaatatattagttgcagacaaatttcagtgagagtgtcagtcaccgtgaattaaatttttaagtgaagtggccggaaaaacaagaatggaatggagcaaagcacatatatcatagttcagaagatttggaattctcccaaacttgtcatcctttaatggagaacctgttaggaacaaaggcagagcctgcattaatagaatgatcttgggaaatgccttccaaggacatctttttaacattcttactcagacttgatattttgaaaggtttttctgttagataaataaacttttaaaaacagtaattaatatgtatcttatttaaaaatagtcacatataatgtaggccaatggataataccattatgcattctgaagggttgaaaattgctagagacccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaagaaaaaagaaaattgctagagacaatctagtctagcttttggaaacaacttttacagaaaataaatgttaaatactgggtgaaaaaacagtggtttcactgttactgacaactatggattaagagcgctttctacccctttctctcgaaacatttcattgttggtagatgaaaaagagagggatggtagagtctgttgagaaatgctctcaacagagaaagtgagttcttcctactgggatgataacattaatatggttctttatcatgttgcaccttagaacatttcagattcctattttgtctagtaaatagttgatcacatggttctctgcatgatgttgatgagaaactttaaaaaaaatctattctccttaaagcccatagttttctcaaaattagcttttctgctggggtgattgcaataaactactactggagtttaaaattgtgcctatttttccaggaacaagcttaaatcctgttaaactagtgtcaagcccatagtttgcattgaagttaacatggagggagtggcagactagctttccgccaggaaatgtgagggtatttagaccccatcatgctgtaaaacatttttcttaaggtgtaaacattggatatattacccaggaagttaaaacatatgcagctaaagggaactggattttctcagtctgtcaaattatgtgtgtctgcttcttaatcattatcatgaaactgttctatgggactacttgaaccaagttagctttcaattagcatgacgttatattggcaggtctaaactgttagacaaaatatgattctggcatggacagtacatacatgaacaatttattggtacatttccatggtccagcactatgacaacttattaaacccttaaaactctaaaacttgcccttctattttgtgttatactcacttgtggaaaagaactccaacctgaattaaattcaactatctacctgctcctcaccttcacccaagttgttcagcattaattaaataaatcatattacctttctgacttagtctttgtgatcacatatctccaatgaacctgaaatggtgtcaaataatccttttttcttataatatctctctctctctctctctctcactttgaagaaacaaggtttcattctgtcgctcaggctggagtgcagtggtgtgatcatagcacactgcagcctcgaactcctgggctcaagatatccacccacttcaaccttcctagtagttgggactacagatgtgcaccagcatgcccagctaatttcttgtttgttttttgaagaggcagggtctcactttcttgccgaggctcgtcttgaaatcctggccttaagtgattctcccactttggcctaccaaaacacttggattacaagagtcagccaccatgccttgaatcacacaatccttttacttctctttgacattcactttaccactctttgagatattattttgttaattctcctctatctttaaacttcttactctttgcacaccctgcacactcagctgtgaaacagtcaacttacctttcctcccatttattattttacaaatgatgcattgaaatagaacaagctcatatttctatcactaaatttaccactctacctttacctttacctctatttagagtagatgaactctgctactatctgaagccaactctgaaggttatgttttccaatgatctctcgaagactgctccttcaactgtctcctcccctatatcaccaatttatctctcaatataaagtcatccccatgagtatacaaatatagcttttttcacatgttaagtaaaatgtcccctcatgctatggccctattgacttcacagaaatatctgtctaaaagttatctgtatttgatatctttgctctctcacattccattatctccttagtcaaaacaatgaggtttctgttcctcgcaaaatgtccacgttaaagttactaatgaacgttgtttaccaaatccagtggtcaattctcagttctcaccttagctgatcctttatataatttgacccagttgaccacaactttcatttcaaaactttttctggttttacgcctacctcattactttctgatttactttactgattctttttttcgatttgttctcattatgttgtagttcaagacctcaatcctgagccctcccttatatttttccctctttagatgactgcattgagttttttggctttaaataaaatctgcctgttgatgactcctaaatatgtacctgcagattatatttatcttatattgtttccatctgtattagttatctattgctgcataaaaagttatccaaaccttagtgtcttaataacatctattatatcatactttctgtgggtcaggaatctgggcatggattatccgggtcctctggctcaggatctctaacaaggctgcagtcaatgtattggatggggcagcagtcatctcagggtctgattggggcaggacccactttcaggttcactcaataatggtttacaaaattcagttccttgaaagttgagccacctgcattttcttaccacatggtcttttccatagggcagctctcaaaatggcagctggcttcatcaaagtgagtaaacgagaaaatgtcagcaaaaggtgggccagtgttttataacttaatctcagaaatgacataccatcactctggccttattaccaagtcactaggtccatttctcactcaaaggtgggggattacacaaggtaatgaataacaagaggcaagggtcatatatggtatgataaaagcatctcaaactttatccaaaacaaaacgacttcctgacttcccaaactttctatgcccctagccttcctcatctcagtaaatggtagcacaatacccctttactctctgaccaaacctggaagtgatctttgatttctcttttactcactaaccatacccgatgtattagtaactcatattattgttatctacaaattattcaccaagtctgatgaccttccatcattacctttgttaaaattgtagtctaagatgatataaattcttgtctgaactactgcattagccttctaccttattaatatcttttcttcctttcttttgttccattatagtacaagtgaacttgttaaaaatgtatattatcttattagtacttgtatttgtctcctagggctgccataacaaattaccacaaacagggtagcttgaaaaagcagaaatttattctttcacagttttagaggctagaagtcaaatatcaaggtattagcaaggccatgctctcgcagaagtctctagaggttgattctttcttgcctcttcctggtttctagtggttaccagcaatctttggctttccttgacttgtagctacatcacttcaatctctgcctccattgtcatttggccttcctcctgatgagtgttagtttgtgtctcttcttctaaggatacagtaattggatttagggtacaccctaatctgttatgaccccatcttaacttgattttatctgcagagccactctttccaagatcacatatataggtactcagagttagaatttcaacatatctttttagaggacaattcaacctgcaacagtcccctaccttaaactacaaatggctttttactacaaatacaataaaatacaaaatacttactctgttaataagcctttacatgaattggcctcagcctattctttgtgtctcacttagttccactctcacccttattcaatctactccaaccacattggccttatttatgttgtacaactatgccaagcttgtcctgttcttatggcctttccatatgttttatatctttctggaatttttctcctgtatccacctgtgactgccttctcctcatgatttaagtcctaagttacagacaacttcttggagaaattaaaatagtaacttctgtactccatcactctctaccctcataatgtgtattaactgacatatattttttatttgttcactcatgttttccctggcaagaatgtaagcttgatgaagataggatatgggtctgtcctgtttcttcttatgtctctaataccctaatatctaggacagtgcatggaatatattggtcaatgagtttatgtccccattataacctaaaagagcaagatgatatgcataatagctaagtagattctggaaagtagaatgctaatttacctctgatcttctgaacttgtggaggtggtaagaactaatgtgtagtatttctagatgtggtgggaagaacagtcaatcttagaagtcaattcttagaactccaagcagggaaaaccatatgctaagtactgggaagttaagaagcaacaagatcaaacagacataaagcaatttatattctctttgaggagacagtgcagctcctgcaataaagcaggaacctcagatagtgaaaatctttgagctgagtgactatagccaatacctagttgaaagtcacataaatatcacttagaatttcagtccatgcagagactttgcaagcccacagtttccagagaaatagtagcatagtctgcaggttgaacattggatatagatcatttatgtcctttgtgtatatatttgcatcagaggtttcagaactgttttatttattattgactatttaaattattgtcagtagaaaacatagaacctaattttctagctgcatgaccttgggaaagatactctaaatagacaacaatagcatctacctgattaataatttctaaggattaataagatagtacatataaagtgctcagatacatgcctggcacatagaaagtgctcaacaaatgttggcagttattattaataatgcttattacttacaggcattgaaaactgaatgtgaaaaattagatatgaacttgtagataatatcacaattatctgtaaatgctaatgataaacaaaaatattcctgttagctttctggcttttcaaatattttactagcttcctattgctgctgtaacaaagtatcacaaacttcgtggctcaaaacaacatagatttattcttttacaattctgtaggtcgaaagtataaaatgaaatttatggagctaaaatcaaggcattggcagggctaggtcttctagggcttcaggggagaatctgttgcttgcatcttctagttcctagtctttgatggaattccttggctcatggctgcatcactctaatatccacttccatcatcatatggccttctctctaactttgacactcctgctactctcttataaggacccttgtgattacaatgagcccaccttgtaatctggaataatctccttatctcaaaattcttcactgaatcacatctacagagttccttttgacatgtaaggtaacatgttcataagttctggagattagggtgtggatatctttgcaagccattattctgtctagcacaaatgcagtcactatcttttaattttaacagttattttgaaacaaatacattctattattgctttttcctctataagaggattctattgacacattggcacataggacaaatacttatatttcttttccttgaagcttcagtggtcatgttctcgctgagtaacgctggggtgactatggagctcttttataaaaggtaactagtttttctgtgctccatggcctcagaatggaatttttattgtttgataaagctaattattgtgaatagtgattaaacttgtgatctgagggtaccagccatgccccagattatttggaacattaggagatatttttgcttgtgacaactaggtgaaggtgctactggtatctagtgaatacaggccatggatgctgctaaacatcctacaatgtacaggacagcccacctccccaacaatgaataatctatctcaccagattaatagtaccatgtttgagaaaccctgccataggcaattttaagaaacagtattattgcttgggcctttgcttttcaaaagtgtggtgcatggaccagcagttttggcatcacgtgggtcatcagtctctttgaaatctccccaagtgatcccaaaattcagccaaggctgaaaatcactgccttagcttttctcccattatcttaccctactcataagttgttatggttatggatatatagagtttaactggaaaaataaaactaaaaaatttgccacgtgtaacaaacatcatatattagagctctaattggcataaagccacctttttcttgagaattgcaataaataataaattcctcagtgtactgaattgtaaacacacagatatgtggtaagagtcaggtttatccaactattcgttaaatatattggcagggagaactcacaaaggagggcaaattcactcagctaggatcatgtttgcagcctgcaagagcgatgatggaatatatttgcttttcctccctggctctgtcacttgcctcatccaatctgctgactttagaacccaaaaagtttctttggtatgggcttttggagctgaattacagtggagggcatgatgaatacgaaaggcgtaagaaaggtgaattagaaaagtggcagatagaaactgtgtagtgtttttatttatgctctctattcttcagcacagtgcactttccattttagctagtcaggttcatccatttacagtattttttcttgtcaccaaataagtgtgagctctattgaatttcacagaattttctggcagtgtatgaaacatatcaatttccccagtaattcccagtaatttaagtttggaattattatacaaattaattcaattaagactacagttatcagcatagccctgttaatattctgtggcttataaaaataaaaggtaacatggatctaactagacaccaatgtttaagggtaatcatacattattgtattcaatgtttgcagtaatcctttgagatacagactattcatctggccattttacagatgaagaaaatgagatattagatattggaatgtcaagtattagtaatttttccaagtttgcatagctagtaagaagtcgagctgggtttcatatacaaggacttttactcctgagtgtgtgcacttaaccactttcattgtatatttcttcaggtctgtcttcacaggcaagcatcggctagtgccagggattttctaaactatattggttacattaggcaactctagattttgcaagggatgattccattgtttttaatgaccttgattgaagccttttcctagccactattcccctaagatgggtagtttctctgctttgccaaatctgagagaaagacctagtgtctcaaaatacatttagttgctcctgttgatgataatgttatggaaatggactttttctatgcacctttgcagttccactgatctcttgtttagcagccttgacagtgtctttatattgttgttcacatggtttctgattaaaaccccatgatactaagctctgactagaatacgaaatctaacccgaattagtttatcatgatttcttttgtttaatttcctttttaacattttattgaacattgacaattatacttgtatatatttatcaggtacagagtgatactattatgtgtgtgtgtgtgtgtatatatatatatatatatatatatatatatatatatatatatagaatgtggaaagattgaatcaagctaattagcgtattgctcatcttaaatacttaccttgcttaaactgtaaaaaatactttatcttaaagcatttattgactaacttgattttaataaatgaatgtagtattaagtaaattaaaaaagaaattaaaacttgactttcataaagatataaaatgaacttttgtcaaagttttatttacatcactaattaatgagggaactagacaagatgttacacctgacttgatggagttgtcaaagaaccacaaatttatatgcaataaaggaatattgaactcaattgaacacagcatgtctatccatagaacaataatcaattgcattctaccagacacaattaataagcatttccatggataagaattgtttgcattgctattagctttctagatgttcactgtatctttacagagatataaaatagcttattcaaaagcaaagttacacatataagatcagataattcccagaggctccacctttccatggaaaggatagctaataatctctcttgcttgtttcagattctcaaatgtttccttaaagtagtattaggtggatacatttacaggcatatctcttccacagtatacatttcattctttcaatcacagtgtgtgtgtgtatgtgtgtgtgtgtgtgtgtgtgtgtgtgtgtgtctgtctgtctgtccagaatctattttaattagattcagattgctaacctggtgttttttattagtgatccattaaagtggatcatatggttgaaaacagtggaagttgttgcattgagaaaatattttgcacaatgtgatttatcaggatgactcttggatttagaaacgtatggcttttacttgtagaattagaattataataaatcattcagattctggaaaaaaagtaatataatttgatcctttaaaaccttttctaatgaaattttaaagaggcataaatacatacatatttttgtaaaaaatagtgcatgttcttttttttcaaattagggaaacatagcaatgtggaggagagccaaaatcagtataattacttatgatagccagctcatgtgatctgctgtgctgtagtttttaagtcatttttctattattaatagtaataatattattcatactatggataattttctctatacagcattatattatgctttcatctcctttccatgttattttgactatttttgcaaattattaatttcagaagtatttgtgaaagctaaataatattccatcttacagatattctctacaattgttactagtcctctatattagtcaatagaaaatataataattatctctttacataaatctgtctggattaatgaatatttaaggtggtatattatttacctatttttacataacaaattaccaaaaacttagcagcttgaaactatacaaatatattatcatgtagtttctgtgggtcaggaatctgggcacaggttagctgactcagttcagggtctcacaagtgtgaaatcaagatgtcatctgggtcttaggtcttatctgagacttgaagtcctcttccaagctcttatggttttttgcaaacttgagggttttttttttatttatttttatttttatttttatttttttttgtggttttagaactgagtccctcagctcctagaggttgatggccattccctgtcacatggctgtctccatgacatggcactttcttgttgaaagccaaaaggaaataatctctgctacttctttcctctaaccttttctatctctaacctctagaaccttttttaaaagaccacctgattaggctgggcccaaccaggataatttcccttttgattaacttaaaggcacctgattagtggccttaatcacacctacaaaatccttctatctttgttatataatataacctaatcatgggcatgatatctaccatatttataggccccacccaaacttaaaagaagacaattctacagggtgtggacacaagggagtggaagtcttggggcccatctcagaatttttaccacttacagatggatttttagaagcaggatgattgattcccagtggttaagtattttaaaggctatatattgagaaattgctttccagtaaaactgtactaatattcactcccatcatcagattatcagcatacttgttttactatatccatattgacataatagtcatttaaataactttgattactattttcctttctctataattatatatgtatgaatatacaaaattacaatcatggcatttttgtgtgagaaaattttatttttatttgacaaattattttagtatatgcttttatttactatcagttttatgattgtaatatttagtgactgtatgtcttctaggtattacctattcacttgatttgttcattttctatattcattccctttgctaattttcccaatagatttgtaagcattctttatattatatgggcactagcctattgatgtgtatgttggaaatatgtttgctaatttatatttgacttttaactttccctatacaatttatatttttatgttctaaaaaacacaataaatattccatttgaattttgactagaagtgcatattcccattttggaaaaatttgacattttatgccaaaattgataaagtagtcaatattttaatcctggagcatattatttgcatgaatttataatggaataaagttttctaacttcttgtcaccataccctactactaataaaaattttacatttctctctttctaatatttacagtcactgcctaggaattccagatcaaagctaaatgaaaatagtaacattaactatccttgccctcattctttatattagtttaaagcacttcgtcagtttaaaaagaaaaaggttttctatatttttatagccataaccatgattttctattccttggaccaaactctgtttcttgaaagtttggaagtactcatctgtattgttttcttcaattaacatttttggagtttatactttaatagcattttgagattttaaacggttttgggtttactcgtaattttcttctgtttaatgaattttagttatttttatccccaatcatccattctgtaaaatttacaaatttagtaaaattcagtgttctaaatattttatgtcattgtatattttataacttcttcagttctaattttgtttatatcattgctcttttttttcttaatagattagagggaagtttcatcaactctttgtaatacaaaaccggttttgacagtctgttctttaagcactattggtttttaacctcctgaagcatatagtcaggacatcttgagagtcaaaccaaccctttccttaccagattcctgtacaacttttcagcttcacctggtgccacccagtaggtgtgccaattatcccatagtaactgcgcttactgctccagtagtctataggtttgcaagacattccacagcattttgtgttagattgctccacagtgaactccacagtgtttaattctcgggacaatatttaaataaggcacagatgcattttggataagattatttgactgctgcgtatagtattcttcatcaccttgtagggtaatctgccaagaagcgtatgacttcagatttttattgataactttggttttttagtcatattgtgaattagcttttggagatcagtttagaagcttggttgtaagatttggaaggtcaacattcccttgtcagagaagcgctataggaataaatggtcttctgtttagaattgtgttaaaaagaaaacaagcaaattcccacagagttttgtcagggccaatttagaaaaaaattatcttggtgacctaaaacttgttttcgatgatctaaatgtatccccctccctactccccaactcatattgaatagattgtcaagtatttagctttattttcatcagtggttttccaaatggaccatgcactctttctgtcctactctacctgtaatctcttgcccaccatttatttaaccctttctaccttagtcattaatgaactccctcttctgcttccaaagtcagcccaatgccaccctcttctgtgaatgttttcatgacctatccaggctgcactgagcactttccatggattcttgagaagtcgtctctcataacatgtatccctttgctaaaattgttgatttccatgtctctcttccatgtaatccttgccacagtgaccatttcctaatcattttgtacctcagtatttagaacagcatctgcatcatgataggcactccataattaaaaaaacaaatgtatacataactttataatttgtgtttaatttcctcaaggtagtagccaaagcttatgatttagacacaagtttccctgtgactaattgtaaatattgtgccttttagtaacttatggttgcagagtatctaagagcttctgtttatcctctccccaggaaatctatctcataacatgcatcgctttgtgtaaattgaactcttggaaaaatactttatccgtgtcaggcacaaatggatacttcaatttttgattagagtgaaaaatggttgctttaatcttgaatatagtaatggcaaaactttaaatattaagtaaaatatagtgaatcatttttttagcataggtaattactacatacaagccaggagtggaaagaaggcataagaaaagagctagcattagaaaatgtctataattaaatgtcattgttaaacactaatagtcaccataaagacaagtattttatttaaggcttatgaaactttgaagtaggtatttgctacctcaacatgttgaggaaaagtaggtaaaaactgaaataaatatggcagatacttatgtccatgctttgtaggtgagaaaactggggcttataaagatgaagtaacttgcttaccttaacatacagtaaggccaataatccaggtttttctgattctaaagcgtattctccctgctttatagttaagaataaaacaaatgagtgcagcttccctccctttcacttccaaatttacctttatattcacccatttgtactttattttctacctataaaaggagtctcaacttccccatactaatatctcttccttctagattctcttctttcctctgaatctcttttgcctcagtttacatatgtcatccagaattccccagttaatcctcaacttctctaccctgaattgtggattccacatccacattcaaaacacattgttgcttgttttgaatgttgtttttgaaaaacattcaaaaacaagcagatgaaacctagtttccaccttggactcttttgattatgcccacttatactcctatttgtgtaatgaaaagactggtcattagcatcttaactctgataccagttgtcttttttatttcgagacaggatctcactctgttgcccaggctagagtgtagtgaaataatcactgctcactccagcctcaacctctggggcttaagtgatccacccgcctcagcctccccagtacctgggactacagcatgtgctaccacacctggctaatttttaaatttttttgtagagatggtggtcttactgtggtgcacagactggtcttgaactcctgggcccaaatgatcctcctgccttgacctcccaaaatgttaggattacaggcgtgagccaccaacgctggcccagatgtctttttttattctcacaatacacaaactctcctgattgtatccttaaatatccttgcttgcttattttacccagtattttctgattcacactccctctgtggcttgcttttctcactttttctccctcttgattcattttgcctgtcctataaatatttgtaagccccagggtggataatgtgagccttcttctcttctttatctgtacttccttcttgtttttcctaatacatgttcttaacttcagctacagttacagtgttgtgttatcttccatctctctactaagctcctggctaatattttaataaactacatgaaagttttaacagggccagtctaattaaataggtaagcatttgtttcctttattggtttgtgagcctttttgattagactccattgcattgtctttgtgtccccactacatcatagcaaaacatcttgtaactagtgtatgctcaataagggtttatcaaatgatgggtttaaatatcaaaattgaactgcatataatagcaaccatatccagtctttcattcatttatttttttccagctagtattcattgagcattggaaattaaaagttgcataaaactcacatttacccttcaaggccttccagtcaagtagaaaactgggatacacagaaaacttgatagggaaaggatgtgaatattagtagtatgaattaattggtagtacttacaataataataaaagtaataacaattaactgcaataacaacaataaaaacagaagctttgcctgtaatctcagcactttgggaggccaaggcaggcagatcagttgaggtcaggagttcgagaccagcctgcccaacatagtgaaaccccatctctactaaaaatacaaaaattagccgagtatggtggtgggcgcctgtaatcccagctacttgggaggctgaaagaggagagtcatttgaacccaggaggcagcggttgcagtgagccgagatcgcgccactgcactccagcctgaacgacagagagagactctgtctcaaaaacaaacaaacaaacaaaaatcccggaagctttgatttgttgttctttcaatgtgccagtgctgttctaagcactatgctatatatactattataatacttactttgcaaataaagaaactagtcacagagaggttatttgttccaaatcacagtttataggtggcaaagctgggatatatagactttctgctcttaaccattgtgatatgctcattctgcataaggtttagtagtggtttatgtgaagccaaatggtgaatggtattgacaggaaacaggcaactggtttcaggtccatttatccagaaattgaggcctcttgaaattagttcaccaatagtataagcaataagaaaatatgtgagaacctcactaaatgattatgtacagtttgtattgctatttctgggtgcaaattttgattatgcaacaaggatagcaaaacttggatgtctatggctagatacatttaatctgttttgcaatttaagacacaataaacttcctcaaagaagtttgtaaagattattatagattgaccaagatgttaagtctgtgaaattctatggatttctttttgtgttccctaatacataaagtttcaagagattcagttaaggatcttgatattaccaaattgatgctttccacacatattaattttaagaaatagaattgcaaactagcctatatgctttatagaaatgaaatgagtaaggaaatagtattttgaacaggagtaaagtaataagatagttgagctgaaaggtcttgcagtgtatagttgggtcctggagtttcttgggcagtgctgattaaacttacacagagaagaactgattctcacagctaacctgaaggctgaaggtgtcaacttgaagatttcctgcagctccagttagtgtggtggctgggaaatggtattcgggttttaggaatgcatgactcagatttgtactttaatgtggcagttcatcagatgtgtctgatgaatcagctctttggattaggtttcatttatgtctttatgtaaacttaaggtctttggatagaaaacttaaacagattgtcatcccttaaaggtgccgccattaaaatagattattttccatgctattacaaattcactgattttctgaataaaatggtgatggtgacaccttgccacaggtgaatggattttgcttttgttttgtgaattaaaatgtgttttaacagacttattaatatgagtaaattaatcaattaaaaccattcagaagtatctgaatgaggctctgggagaacccaaaatgtgatagttttggcattttcatctttaataaagttatagtgattgagagctggattgatcagtcctcaagtgtcttgcaaagaaaggtgtcctgtcataagtttacaatatatttgaactgtgttctgatttcccactttttgaaagtcggtctttcagctccactatctcagtcttatacaaaaagaaaagaagcagagagtagaatggtggtggccaagggctgggacaggatggggaaaaatggggagatgttggtcagagggtacaaacttgcagatatacaatgagtacattctggggatctaatgtacagcatgttgactataattaatgatactacattgtatacttaaaattttttgagagtagatcttaagtcttaccacacacaaaaatataacaactgtatcagttgaagtatgtgttagctaactttatagtggtaatcatttcacaatatatatgcatatcaaaacacactgtacattttaaacatatccaactttgtgaattatacctcaataaagctgagacacagaaggatgattttctgaggaagacaatgttcgtttatttaatttcaaatgaaatatttctcctttagaaatccaaacacactaggttagtgtcccttcttatattcctctgcaagccttataatagaaagaaatgatttttgggtagtttcgttgagtgttgtttcttcttcttctttcttctttcttcttcttcctttgttgcttaggctgtagtacagtgacacaatctcagctcactgcagccttgacctcccaggctcaagccatcctcctacatcagcctcccaagtagctgggcctacaggtgcactccaccacgcccagctatttttttttttttttgtagtgatgggggttttgccatgttgcccaggctggtctcaaactcctgggctcaagggatctacccgcttcagcctcccaaagtgctgagattacagtcatgagccactgtgcctggccagagtatacattcttttaataaaaacaaaagtcttaaaattatcttacaatatcttttagaggtttttgaaagaaaattataaaatcacgattaaatattttgaggcagacagcttatgatttaatctctgttggaaagaatgacactgaataaaaccacattctattgcagcatggaatgttaaaaatgtcagtttggatgatttttattaagataaattgttagtgaaataattcttttgacgggattgtttccatttatttaaatacaactagggcgtttaaataaaaaatccaaaacctcaagtgaacataagattttaaagcattttgggggtgagggctatggaggcataattttggtattaccagtttcgatttaacttaggaaccacaacatatgggaaaatataatagaaatcctggttatattctttccttttgtgtaattcattgcaccgatcatgtttgatcaaagttatgaaactctaataatattgctatctatttttaaaacatgtatgtttttcttctttttaatctttgctttagggaacggcctttaagagctggaagatgaaagctccgattccacacttgattctcttatacgctacttttactcagagtttgaaggttgtgaccaaaagaggctccggtaagcagtattcctctattttttatgtgtttttatagcttaaagtgatagtgctacatctacacatgtgccattagtggaaaagttgagaatgatcagttatcaatattgtggagatattgtagatattatgagtaaataggtggagcacactcatagggaattaggaaagtgagagtggattcaaaagaatgtggcttattttatcgattactatgaattggcatggattcaatagcaaagccttgtatttagatttcattttgtggtaggattttaagtattcttatataaacagtgttatttaattttttgcatggaaatattattgtatctttgatgttaacttttattgttaccattttgatgtcagctatacttagggaagattcttttcagggttgtactccagctgatttgatgaattgcttggaagtatataaagaaaatactagtgttattgaagaaaatgtcatgaggaagcactaatattttaataggaaatatagaggtaaagtaggatggtaatgaaaggaactactaaatagattaatgttggcatttatgaaaaactttacatgttatcaggcatcttggtttgtagtggactgttgatagttcaattgtatgggacaattgaataaataccattatcaatgtgaagttgtatcttgtctagtaagtcactaataatataaagccttgccatgctcacactatgtggagtcacataatttttgaagttatagcttttaggtatgaaggaagatgaagggtattgtgttttgttgctagaattagaatgtattgtctgttagttctagagagcctgtgggaaaaagaagatgagataatgtacaagaggttgcagtgttgtgatataagcaattgcatggacaaaagcatctttggagttcagaaaggaaagggaatgaaagggctgagatggggctgtgaagcaaacatcttaaccatgaggttaaaaggcttcaaactcactttgatgatataacgaaaaagcccacatgcaggggaaatagggagcagctctgctctcgtgagcccctcctggggataaagtctgaagggaaactggggagggcattgtgcatggacaaaggtttggtgcatggttgaaagttaaaaaaaaatactgagactgttggttctagcatatttggttattatacagctgttgtatctgccattgatgtggttataggcaacgtgaaaaaaatactgttgttatgtctacacattatttcatctcttcttctcagtggatcttctgaatgagataaaaccctagggcaggattatgatgttgtggtttatgtaattcaaatgggttaatgggaaataacatatatcttgatttctttaattgtactatgctcaagtacaattgagcataaccaagagagttagagtaggtagaaagaggggtaaatagtgatgaaagctgataatttttacaacactgatgttttctggaatagaaatttacattaaaatcacttaagataggtttttgagatagtagctatatataagagaaacactcatttgtgtaagtattataacaaaatgacaatagttcatccaaaatagaaatattgattaattctttaaaactttatttttctggttattaccactaattatataaaatctgtttttttttcagttctttctgtgtatgtcagatctatgatttatttattcaaatagaaatgttactcctttttaatcataaagtaatggtgataggtccattctatataacctctaatttgggggcaagaaattttatcaaactgggacttactttgtgtgtttgagaagcatgagagcagagctagaaacatggggcagttggaaaatgcaaatttaatataaatgcaaatattaaaatgtctcaaaaatctatattaagtgattttaatgtaaattcctattctagaaaacgtcattgttgtaaaaattttctgctctaaagacctgagaaaactcaagaatctgtctcaaattcagttttattttaattttgtaattatttgagaagaatggtaataagatgctgtgctaagctaagcagaagttctgagacctttctctcttcagtttatgaatgcagttgtcacgtaattatataataccttctaaaccaaatgtgttttctatattataatgtaaaaatgacaaggcaggtactgggattttgcagcatgcctgatttgtttacttttctatatgatgtgaattaacataccttccttcccctagtgtctatattaagatccagatggatggaggcttgtttgtttgtttgatttttggatattaagtgtgcactttgggaaggaataatattattctatccacatactttcatagcttggactgatttcagctgatgtctgttcctgtggcacctttgtttgaaggaagcagatatgtagcttactgaatagtgtcattactcatctccatacatcaagtagaagaggagtgtagttggcatcttttccttgaaagattaatagctcaatcttcatacccagcccaacctataaaaccagcagcaccatggccaggggataaaaatcaatttttgatgtttgattttacgtattaaccaagaggacttcttatctttcttcttttgtcttatcatttaattctcttttgattctttattttattcatctttttgaaaggtcagtaaacatgactcaaaacccaatgcttttcatgtgtcttttactagaatattatttttagttcactgtgaccactagaaaaccagaactagatattttaataattaggaacatatacaatattatattacacagagaaatattgatttttaatggcatgttaattttgtagagtgtttactttagattaacacatatggtcattccataaaagtagatattgttttctcattaacagaactaatttgaaagcaataggaggtcttattacacaagctggaaatgcattatttttatcacattggcttacagtcccatcgctgttaatttaaggaacagattaaatataataaggcaggccgggcgcgttggctcacgcctgtaatcccagcactttgggaggccgaggcgggcagatcacgaggtcaggagatcgagaccatcctggctaacacagtgaaaccccgtctctactaaaaatacaaaaaaattagccgggcgtggtggcgggtgcttgtagtcccagctacttgggaggctgaggcaggagaatggcgtgaacccgggaggtggagctcgcagtgagtcgagatcacgccactgcactccagcctgggcgacagagcaagactccatctcaaaaaaaaaaaaaaaaaaaaaaaaaaaaaatatatatatatatatatatatatatatatatataaaaaataaggcaattatatcattataacattcttgattgaaatattaaaatgcaactttataacattttgttttaaatatcacttcagatatgtacaatatgtatgacaactaaggactatatctggtctctcaggtaaagtcctaaagttgtgcctacatttagaatgaagacttttaatatctatggaagcacatattcagcattcgttacacaatagattttatcctgggacaatttcatacctattttttttagtttttataagtagcacttgatgaaagaggctaagatgaccaatattaccaatccccgtcaagcatgtgaaatattatagcaattcagtaagtaaacatctcggttgctgtcatttttagaattctgaaaaaaaatcccccacatgtaaagcaaacgcttgcttggagaatctttgtatctcaaccagttgaggaaatttagctttacattcttgtttgttggtccctttcttcattccttcctcccttctttccctttttgttctttccttccttccttcctttcttcctcccttccttcttctctgctagtatatttatctgcaaataaaaataatttattttcatattcccactgtgtcttggtaggacttttcaaactataaaaatattattattactttgtctgcatggttgaagtatttgaaatattctatctttacaaggccattcaaagaggttagcatagtctttgttaataatagctattcttaaatatatacattttaaaatggtgtataagaaaatctgcagtaagatttgggagcagggaaatagtataaatagttgaaggactgttatggacaaagtatgactatagcactttgcggggactaaagtgtgagttgtaatttgcctgaaaagtttgggatactgaagaaaaatgaagctagaggggtctggatgtagaaattaggtaagagaaggggttccatgatgtttttctctcaaaaacatcctcagaatataagatggtgagtgcaaggaccatgattaatgtatgcttataatctctacagtgccaaatatgctgtttcagagtcagggttcaaggaaatgtcttaatgacttaatgacttaatgactgcatgaatggttgagtgagtggttttaataatcagagttacatcagtgaggatgctacaggaccaaaacgatattagaaagataaaggtaaaattaaatagaggcatttaagaaaaatgatttttttttcttaaagagcaatcagtataatgtataatgtgagactactgaagcaaaagatataacccggaataagcaatatctaggacataataagggtttagatgaagacaatgaacctttacaaatggggagtgttttcatgggcttgaaatgcagttcaaaatctgttaaagggtaaggaaaatgattcttcgagtatttttctattggaattctactacgtttagtgccgctttaaagaagtactaatgtcattgtgcagaattttgaatttaatggtattgttccataatggccattatgaaaaggctgtagctcatgattactaatacaggataaataagcaagtgacttcagtataggaaaaaagtattcacagttattagaccatatggagaagagtaagtggctgcattaccaaaaagcacgttattttaggaggaatttcatctatataaaagctccctaaagcatccagctattagagagtaaaagggttaccaaaaggagttgatcttctcttcattctagaacctgacaggggacacctgtttgtgtaaatgatttagatgcaattcttctagacagcaagaggaaggcaagcctcaaaaggttttcctaaacttgtgactctaggcccaaataatttataaaaggtaagagtagtcaaataaccaaagacacagtttcagttctaatttttgtgttgttatgtatggatattcatttaagtaaaagaaattatactactgtgtaaagaaagcgagatttaactgaataggaatgagaaagtctagtgggggtacttccatctcatgtcaatgtgatttatgtgcagctgctctcttgagcattcctgtaagtcaatgagcttaatttcacatgattaagagacaacctagtcccccagcatctgccttttattatgttaccatgtgtttattctcagtttgtcaaatatgtcaaaaaagataaggtgtttctccttattttcctttggggtagcttataagaccaaacttctgggactttgtttctttaccttttgaagttaaaaaaaatgcactttaattttttctcaggaaaaaaaattctcctatttattgtaatttttacaaattttgaaattagatctagagtaattttaatattcctttgaaattatgtccttaaataaaataataagtctaataaaaatggaacttgcacctaacaaacaaaataaaattagccaatgtctttgtttagttatatctatgttctgttatacctatattctgttatacctatgaatttccccacaaacttacccattcagttttagttgtcagtataattttatatagagttggcacagatgaataccaattgtggaaaatgatgcctgcttcatggtgagttaaggataaaaggcagtatgaatgaatcttccaagttgactaagacttcaatgaggaggagaatattccaagttaataagtatagtattccaagttaatccaacttattaacttggaattcaaactaattaacttggaatattattattattagttgtattagtattccaacttattaacttgtattccaacttattacttattattgcttataataagtaataatattcaaagtatcataagtatataagtgtggtactgtattatgagggtacaaaataatatattgttctatgtatttgatgggagaggtgaggaatagagggaagcagtatagaagctggcaaatggtaggcaatataagtttgttagagaaatgatgttcgtattattccattttcatgctgctgataaagacatacctgagactgggcaatttataaaataaagaggtttaattgggctttccatatggctggggaagcctcacaatcatggcggaaggcaaggagaagcaagtcatgtcttacatggatggcagcaggcaaaaagagagcttgtgcagggaaattcccgttttcaaaaccatcagatcttgtaggactcattcactctcatgagaacagtgcaggaaaggtctgcccccataatttaatcacctcccactgggttcctcccatgacaggtgggaattgtgggagttacagtttaaggtgagagttgggtggggacacaaccaaaccatatcattccaccccggcccctcccagatttcatgtcctcacatttcaaaaccagtcatgccatcacaacagtcccccaaagtcttcactcatttcagcattaactcagaagtccacagtccaatgtctcatttgagacaagtcaagtcccttcggcctatgagcctgtaaaatcaaaaacaagttagttacttcctagatacaatgggggtacaagcattgggtaaatacaggcattccaaatgggagaaattggccaaaacaaagggactacaggccccatgcaagtccaaaatctagcagggcagtcaaatcttaaagcttcaaaatgatctcttttgactccatgtcttgctcatctgggtcatgctgatggaagaggtgggttcccatggtcttgacagctctacccccgtggctttgcagggtacagcctccctcccagctgctttcacgggctagtgttgagtgtctgtggcttttccaggcacacaatgcaagctgtcggtgggtctaccattctggagtcttgaggatggtggcccccttcttacagctccactaggcagtgccccagtagggactctgtgcgggggctctggccccacatttctcttctgcattgccctagcaatgattctccatgagagccccacccttacaccaaacttctgcctgggcatccaggcatttccatacattttctgaaatctaggtggaggtcaccaaacttcaattcttgacttccgtgcactgccaggctcaacaccatgtggaagccaccaaggcttggggcttgtaccctctgaagcaacagcctgagctctgtgttggtccctttcagccacagctggagcagctgggacatagggcaccaggtccctagactgcacacagcaggaggaccctgggcccagcccatgaaatcacattttcctcctaaacctctgggcctatgatggtgggggactgctatgaaaacctctgacataccctggagacattttccccactgtctcggggattaacattcggttcctcattacttatgcaaatttctgcagccagcttgaatttctcctcaaaaaatgggattttcttttctatcacattgtcaggctgcaaattttccaaacttttatgctctgcttccctcataaaactgaatgcctttaacagcacccaagtcacctcttgaacactttgctgcttagaaatttcttccgctagataccctaaatcatctctctcaagttcaaagttctacaaatctctagggcaggggcaaaatgctgccagtctctttgctaaaacataacaagagtcacctttgctccagttcccaacaagttcctcatctccatctcagaacgcctcagcccggaccttattgttcatatcactgtcagcatttttgtcaaagtcattcagcaagtctctaggaagttctaaactttcccaccttttcctgtcttcttctgaatcctccaaactgttccaacctctgcctgttacccagttccaaagtcgcttctgcattttccggtatcttttcagcaatgccctactcctggtaccaatttactgtgttagcctgttttcatgctgctgataaggacatacctgagaccaagaagaaaaaaaggtttaattggacttacagttccacatggctggggaagcctcacaatcgtggtggaaggcaaggagtatgtcacatcttacatggatggcagcaggcaaaaagagagcttgtgtagggaaattcccatttttaaaaccatcagatctcatgtgactcattcactgtcagaagaacagtgcaggaaagacccacccccataattccatcacgtcccaccagattcctcccatgacaggtgggaattgtgggagttacaattcaagatgagatttgggtggggacacagccaaaccatatcaatgtttattgtagagatagcatacaggcattcactgctaggaccagaggattaacccctgatccactggtggtcaactataggcttgcacgtgatccataaggtggcttggaaattagggacactggtgtatcagtatcttactgatgttttaacaaattgctacaaatatagtgacttaaagcaacacaaatttattatcttacagttcttgaggttctttatcatcacatctcctctgactctgacccttctacctctctctttcccttataagggtcttcattattatattgggcatcctcagataacccaggacaatcatttcatcttaaaatcatgaatttaatcaaattggaaacgtaccttttgccatgtaatatgacatagtcatatgcttcagggatgaggcagtagacatctttctagagaacattatttagcttactgcaactggcaattagccaattcaaacaaactgtctattgaatgcgttgaagactagagcaagaattgtcagccaggagccagatgggaatggaagagaaaagaacagggaagttgaaaacttttgctgaagggcctgtgcaatccatggtgcatgataaaaggtgcagagggtttgtagcaaaagaagaaaagggaaagaaaacagggcagagggaaaggaaggatgagagatgcggaaggagaaagaggaaactgatactagtgatgctttggatcttaagaacattttaagattaatctgcactccacacatatactttcaaaaatacccccttttctttgtggtaggctaaaggcgtctgtgttcctttcaacaaagtaatacctgacctgaaaatgatttccagacgtaaagtaatagcagtgagaatagtgaagacagaagagagagcaattttaaagttagactcaattgaaatagatgatcaattagatgtgagaggttataaagaaagaggtaaagaaaaacattctgtaatgagaggattgggataccatccatcatattaaaggtccccaaagcacagaaacttgaaatgactacttattgaaggaaaatagtaaggtctttgtgactaagatgaagccccaaatgtagattgaggatagaatatgagggattttgaatatcttgcaaggaattttagattttatcttgagaacaaaatattttggctgagatatttaataactttgcaaatccctttagtagaaaattcagtctgggtggttgggcctctgatttgatagatctgttcattgtggtgtcttctctacaccataaagatgaaacttcttgctttgtgtatgatggtgttacacacatttgtgagtccatcagtaaagctgcctttgcagagaagggaagacacacaatcaaactatgtaggatcatacatgaaaatggcatggtcaaacctggtgtttgacatgtaacactccctgtagaaaagactagggtgggattccagaatgaccagtaagggactcgataaaaatcgtatttacatatactgagggcctgaaaagcaatcaaaggcactgaaaataaatttctgaagaatatataggatctagtgagtgtttggagatgaattgtgaaataattcgaggagaggttatattgatggtgtcgccaattacagagagaagatgaatggcaatttttgcggggagagtggatggaatgaagtcaattcggaacatacaagctgtggtagtcactggaagtattgagctaatggatttattggtctggaattgtactagtttcctgtggcttctgtaacaaattgtcacaaactgggtgacctaaaacaataaaatttattgtctcacagttctggaggccagaagcccgaaatcaaagtataagcagggctacacttcttctgaaggctctgtgacagaaaacttccttgcctcttccaccttctggtggcttcagttttccttgggttgtagctgctaccatcttcacatggccttcccctctgtgtctttaatctccttctgcttttctcttataaggacacctgtcattggatttaggatccactgggaaaatccagcatgatctcattttgagatctgtaaccttaattacatccacaaagattctttatccaaataaattcatatgcacaggtcttggcggacatatcttttgggggaccactgttcacactgcaaatgtcaaagcaagaggtatggattttgaaattgtcctcatattgagagcaacatgatggaatgagattatccagggaaaacatgcagagagagaagaggaaaagaaaagggaaagggtgaggatcaaggattctgtggaacactagccctgaagaggctggcagagaaagagcagccagtcagggaaagagactaagggaaagctaagggaggaagaaagagaccttacttgttttggttcctgcaaaccaagagtggagaaagtttcaaaatgaaagaatgatcatgttacattctttggaaagttgtgtcagataactgaaaatacgtcattaaatgaagattcaggaaaatgtaggggtggagagacaacggagtctgaaagaagttgatgtcaggttttaaaaagtatatattgtacaaaatcagtatattaaagggcctttgcatattaaagggattttatttatttatttatttatttatttatttatttatttatttatttattttgagacagagtcttgccctgtcgcccaggctggagtgcaatggtgtgacctcggctcactgcaacctccacctccagagttcaaatgattctcctacctcagcctcctgagtagctgagattacaggcacccgccaccatgcccagctaatttttgtattcttagtagagacagggtttcaccatgttggccagggtggtctcgaactcctgacctcgtaatccgcccctgcttggcctcccaaagtgctgggattacaggcgtgagccaccacacctggccagggattttactttttaaagtttgtttaactgtttagaaattatgctttttctatttaggtaaaacgagtataaaacttgtggtcatccatgctaatgaaaagaattgtacattagtacagatataatagtatagataaaattttttccaatcaaaaacttctttttttttccaatcaaaaacttcttttagcaagaattaaaacatgttttgccatagataaacctcctgaaggaagggtgatactgatttaattttcgttttttcatttcataaatacagatatggaagatagcttacaagtgtattataattttccacggttaatcttcatgttaagtatcgtaagttccaggaaaggtctacagacagctaatatttacactccaactttcattcacagtgatgatcacaaaaattacatctttttagttagtatctcagaagtggcttacattaatctgatgagtattatattaggttggtgcaaaagtaattgcaatttttgccattactttcaatggcaaaaaccgcaattagttttgcacctaccttataatacccacagcagtggaaattaaaacacttgggtttcaatgcagctgctaacgagccttgttgattgggaacatgtccctaactgaagctgtcatatctttggtttcctttttcataaagttttgcactacaacattgtccatacaaataatagttcatctttttgttcctttcacaaatatttattgagcactttcaatgcatactaagtatatacctgacacttttttctgtaacttattttacatgtttgcaaattgatcacacgtttaaaaaggcagagtttgtgaccagagtacctgaggcccattgttagctacatttaactttgtgctatacagtttgagtcagcactacagagtggaggatgttattagcttaaaacaaaggttctgttaagagaaaaaaaaattagtttttatttctttttaaatagcacacagtatatcattagaaagccaaattaaaaataagatacttctccttgcatgtggtgatgtgattaagtaaaatttggtttgtcagtttcaaataccaaaccatgttttagtctatttttgcttatttaaggcaaatttctttttgtagagttatggtctcttaagacatctatgcaagacaccttgcatgggaaatgttgccttaaggcgatgacagtgaataactttgccaagttttaaaatctctgagggttatatataaatatttcttcaaaaaatgtcagtgagcctcttgtgagtattctcaacactattcaattgtcatttatgttttactaactgtactaaaatatttccaaattagttttgctaccttgagctcaataaagtactgccattggcatcttactttaagttcttaatgcatattccacttattttgtattccaaatattatgttgtaaatagtaaagaaaaattattcttatcaatgatgaagaaagattttcatactctggtgcattaatatttttctgaaatatattgtcatatcagaaaaaatgcaactatctgaaaagaggattcttccaattttttctataaatatgttctataaagcaattgtactctccaatgccatcttgtggctttttaggattgatgaaaatgcggtaataaacacagaacacagggagaaataaacatgggaagaaaacttctgatgaattattgctcagtgattattttacttgatcttaatactgttcaaacatttatttgccctgatttattgccttaggttttataaagagtatatatatatttctcctatattttgctacatttttataatagaaatgttcattgagatcttgtaaggagataaaaatatcgtatttttatgatcttagcatcatgtccatttgtagccctatattaccagaattcaaattattttgacaagtgcattgatattatagacttattaaaaatcctcttttaatacattgctgtcattaaggtcttgtcattttaataattcaggtgtcgaaaggagaaaaagtcattaaagattttagttgctcactattataaataagagctgctgagaagaatatggaagtgaagatcttgtgtggatagatgtgtgcttcacgacttaggttttcctgctggtctattggacaggccttggaataggagatgggagggcctaggtagaatcaagctaaatggaaagcactagtcatcaggcaaagttaccttgaaaaagcagttacttttatctgcatgtcccaaagaatgaagaccaagagaaattattggtcggcaatgttttgtttttttaaagtgaaaaattttcaaagggtcttaacagttataaatgcgttttcaaacgaaaggcatataatacaccccccacacacgaaaatattagcatgctaccaatgttttcaaactttgataagaatatttttcctgttatgagcactcatctaaaatatgtacaactgtacttgattacgtgtgtttcttttaggattttatgcatggaacctacttcttcttaaaggacaaagtaacaggttgtgtacaccaatgttaacaagcatttattgaattcctagtatataccaagtgcttgataacattgattcacatcagctatgcctgggcataaaaaaggttaaaatgtttagatatttgtttgtagaaacttgccttttgtattctttatttaaaaaacaaacttgtggaaaattttattaatagaaaccaaggcaatatgatttatctttattaatttgatcattcttagttttctatacctatgaatcatatcctgaaaattgtttatataatttcctcataactttgctgatttttttaagaaacatatggagtgcttatttttgtaactgcatgcctttttactttataaaatccatgtatctgtcatgtctttggaactggtggtgctataggcattgtcctttcatattcactagtcagttctaatttattctttgtatttagcaaatgttttcagacaaaacatactgtaaacaagcaactggactgaattctctgggggattaaaaaagatgaacaatctaccacctctgctattaaataccttgcaaaaaataagtgatatgagatatcatacatgtatagtatattactttcctattgtagctgtaacagatcaccacaaatttagtgtcttaaaacaacacaaatttattatcttatggtgatgaaggtcagaagttctaaaatccaggtatcagcagggatgcattcctttaggaggctccagggaagaatctgttttcttgctgttcccagcttctagaaaccacctgtattacttgtcttgttgctccttcctgaactcaaaatcatcagcatagcatcttccagtctctgtaacctttacttctactgtcacatctccttctctgactctgactttcctgcctccctcctgtaaatatccttgtgattacattgggcccaccactttaatccagaatgatctctccatctcatgatccttaacttaatcataccttctaggttccttttgccacttaacagtcacaggttctaggaattaagatatggacatctttggagagtcattattctgtcaatcacagtggtatattagagtagcttttacataaaatagtttgatatggatggaatacatctatatcagggcacagtacagaataagtgatgagggagtgtcaggagaaaaggtggaaaaagatagatgggagccatatcacaaggactttgtatgacatgacaagaaatgctaatattatgctctaggaagtcaggaaccattgaagaaattgcagcagagcttagtaggaataacctgaccagatagattggaaagagctctaagacaagagagtgggaaatgaggccagtagtccaggtaagaaagtcatgaactgagccagtaacagcaggaataaaagaaagagagatggatttgattgctagtaaaaactggaagtaataaaaactagcaggtgattgtacagtgaagagagggaggtggaaggtaattccagctgcttttattaagttaaaaattctgttgagaactagtagctaatgttatatttctagtctatatttttcctggtcaaatacatttttgggttttcaaaatgatgtatcttttgcagtgtggattccgactgacaaattgtacatctgaaataaaaatctgcgtttgggtccactgtagggttctttcaaatgtcttctacccttgtgcctataatgaagtattgtatcaatgggtcttgccttgataatctcagtgaagaacttcaagttaacacagggagaagctttttatttttttaagatgtcaagtttcttttagtatgtagtgctaaattgtggtatacctacatgcatacacacatatgcacatgtatccactcaaatatacacacagttaactattaattcacaaaacacacttgtattgcagctttcctatatgccagttgctgaggattcaaaaacaataagaatatatgatcgctgcattttaaaaatatctgttttatttacctaactaaatagtataagctcgttgagtataaaaacatctttatccgtttttatatgtatacatatatgtatgtatatatatatatatcttttgtaatcgctatgcttaaaagagtcattgcataatcagtactcagtacatctttgtatttcatttctggatttaagaacactgaaaaatctcatcacagcactctctattttcctgtggcaatgtacatgcatgtcataactcttctctgataccagaaactccttgaggaatgatctctatataggttaagttcattaatgaggctttacacatagcattatttgaccaattgttatataagcaaatgaataattttaacttacatgaaatgaatagtttcattagagtttacatttctctgaaaaggaggaattaaagctttatttttagttggcagggtgacctgaccattcatggttattgtgtataatcccctgctgaaattgtaatagctgaagctgaaagcactgagactatactggaaagtgaatcttgagatggcactccttctttagctccaaagggcaaattttcagttactttgttataataggaattgtgcagcttttgcctccttcttatctttgagagattttgccatgtctgtacatatgaaggtcattccatgaaggaagagcagatacacaaaaggactcctgcatggaagcgtggctggaaggagtaaggcattagccaaagcagctgctcaatgtctccatgtctctcagaacggatcataacaaaccctaggaatgctggtgaatagaagtggcctacaacattgagggtgtttaattttaattcagaacataaattagttcaatttggcaacttgcgcattcattctgccactctaactgacatgctgctccgtgatgaacagtgatgacttactgtttgtttcaaaggcatgttttcgctttctttgggagacgtgcttggtttgttttgttcaatttttaatgatacatgattttattttaaatttctttggaaactgctttgtatcctagggtttccggcttcctgtgaattgaggagaggttattaccttctaagttttcaattaggaaaacaaagcaagtttggaagctccgttgggaccttgtaaaccctctcaaagcatgttctgaaagagacaatttttgtgcaactagctctaattgtctgagatgagactatctacagaagctaattggagagtgtctcattctgcagcatgtatggagtcagcagaatagtaattttgctttcttgggttgtttttcctttttgttgttgttattttgttttgtccacacttcctttcagtacctagcattttaagataaatctttctcaatttaaaattacttatctctaatggtaaggctcaggatttccatatagacccttcccaaactctgtgtaataatgttcctaaatcctcaaccattctttagacctaatatggaattagtaagcctttgatggacttgtattcccttttgctttacctggatgtgatattaaattctgtttcaattttaatgtttgtgttctgaattacagctggtaggtacagaatagtatttatcacattttctttcttatgatcaccacctgagtgattacgttgttgacatattctgaattagacaagaacatatgctcaactaaattgatgccttacatagaaacttgcatataatgaatttcatttgtgcagttattttaatttttgattacactttttggttttagttttatgttttctcatgcttctctaaagctgttccatcatgacttaaaaactaagacttctctgaaacttggaaatttattatgcagatctcataattatcctaactagaaaccaggttcaatataattaaggaaaaatatttaaactttatagatgtacgccatttgttctcctattcatcctacatttgatttttagtttatagtctttaataagtggggaaaacagaattacattgacactttttggatttaattggaaggttttcagaaaagctcttttgcatcagactatctcttctacaaatgttctagtgatgactgatgactctagaagaaaactccatcaaatggaaggtagaagaggagtcccaagtaggaggcagctgagaatgcagagtaggagaagcttctgaggcagtgtatcaagtaatatgtaaggacagagtagagacttgtgtcttcctccttcttctttctgtgtccaaggctacactttgccattatatgattttgacatcaaataaaaccagttttcctcgcagtagattgaggcaggtattatgaagaaaaggatggacaatgccagtggattaatggcttaactcagacacgtttctgttgtgaagaaaccttgagacaaagtttaagactgggaaaaataacattaaaatcagatgttttgagttaagaaaaaacatatagatgctgtttgagatcattttaaatggaaacacttagtttatgccaccatgtggttataccacaccatctgtaaattagtgttcaatgacacattattaaaacttatacattcaaactcatggttaattttaatctagatgcctacatctctgcgaattgcaagcatgtaaaactgaactcaacttgcattaatacatgaagagttaatgagaaactgttttcctgtgtatatgaatataaatgcatgttttactatttcatatagataatttatacattctttacatgctttatgggattatgtagttacatatttatatgttataatacttgaattggaatgggtattaaacaagacgtaggcttttaatatgaaaatattaatatgctttaatataaataagttaaatattttttggaaaacaaattaggtattcattgccagcttataaatatgaagccttttaaatttatacctcactttagccaaaagaggttacgttactctttgcaattattatttttaggagaaggagggtatttttctactattgttgcttttttctcagcatttttgagtcaatgggtgaaatgcttttactcagtgctgtttttgcaccaagtacattgttattttacccattgtaaattattctctcaatggtttaacaggctaaacccttaaataagaggtgtctttttttaaagaaaatatttggaaacgtgcaaatgaaaagagtaaatctatttttggtcgggttgtccaaactcttcttaggatcttatagctagtatttgcttttttaatggctgtttgaggtgtgtttaatttaacaagaatatgccagggatttactaaattatataagacagttctttttttcaaaaagtagatctagtaattttatttttcatttaatactcattcaacatataatattttgagttgtctactatgtgatacctactattctaggaacttaggataaaatgatacatgcatttctcatgaagagtacagcctagtgggcttaaataaacaagataatttcataataattcatgctatgaataaaataaaacaagttagcatgatagtgattggcaaaggtagttacttcagatagggaggtctctttgcaaagatatcatttgagttgagacttgactctgaaaaaagagcccattaagtgagaacatgggaaaagctcattccaagcaggatagtgagtaccaaagatatgcagcagtagcaaacaagacacatttaagaaatagaaagatggtcattatggatgacaggtagtgacgaagaatcatgcagtgagtcaaattgtaaagttttcaaagggtgcagagcaatgattggaggagtaaaatggaaggaaatgttggagaattagccgtggccccttaggtcatggtttagagtatgcattttattctcagtgtaatgcaaagccattggaatctagcaaatggaagactgagtatatgatttacattttttccaaagaatctttttttttggctgtggagtaagaagctatttaaatcatcctagcaacagatgacagttaccagatcttgggtattaagtggaagatggagagataaagactggttcgggtacagtttggaagtaaaaccaaacaggacttgatggcatactggatataggggatgaggaatatgtaagggatatataccatataaagaagcacagatgacttctaagttttatgagtaactgtattgatggtgggactatttcctgagatggggaaaattagaggagggagaggttcctgttttcgaaatgtagaattaagttcgagattcctattcagtcttcgagtggctttgtcaaggagtctgcaggcagctcagtggacaggttaataatggatatttaagtggaaggagccattggcatgtaaattgtattgaaaaccatttgcctggatgagatcactcaagctaagtctaagtagatataaaaagtagaggttgcaggacagaaccctaggatacttcaacatttccgtagttagtaaagaagtgagataccagaaaagtgagagagaaaatatgagtgtgatttcatgggagctcagaatgattcaataatacgtaattaaatgtattgcatagagctgagaagtgaaataagatgaagatagaagattgctcattggatttggacacaggtataactatcaataatgtaaagcaatcaatgaatatcacagaaaagcatagaatggtgggtaggcagaagtcaagggagcaagcccagaagtcttatttgcaatatgggcatgacactgcagcaaatttaaaatcttctattgaatgtaaaatgcatatgaattttttttgtatgccactagatagctaaaggtgaacatgtaggccaaatggaaaagcaaaaagaacagaagcatagagatcaaactattttagggaacaaaaactagttaacatcaaattgattgaaatttgcttcacaaccccatatttctcatgcccactgtcctatgagatctattatgctgttatgtaatgaagagctgtgttaattattcctgccacctgcatctaatgaaattagatgtgaaatttctgataggtacagatggccacttgaaaaaaacaatccagtttttcttttttttctatcagctggtcaaatctcataagttagaaatgttcagactataaaattaaccccagcattcttcatttgtatagatactaagtataaatgacaacttcctcaagcccaaataacttgtttggatttagagtttaaatactatccaattaagtgtatcatgctgacacattgtcatttaatactccctttggtagagggttaagcttgttgaattatttcaacttaaataatctgataaccctctcccagtttagttcagttaattttatacaaataaaattaaatctcaaaatgcatataaagtaagagcataatacagtatgtaatggggcataataaagttgccaatattataatgaagcgcatagaaaaagtgtgacctattgtaattagtaatgtgcacctctgacaaattgtaaagcatgaattttcctggtaaggaaaaagagaatgtgtggtaatggtagctaaaatcctattcgttttgcatagattgctatcaatattctgaagctgagggttgttgaagttggaatttagatggttgaatgaagatgtgctctggaaattaggagtacagatagacccacatggtcagataaaggaaggctgacagaataaagaagcaagacatgggttggttacttgagttgtggagatgaatgtgaaataaattgaataagatacaatgattagaaattgatacattaagcctggagatgaatacaatgattacgaatatgttcagacccacatatgtaccaaatgcaatggatgtcagacatctcactgtgaaagcaggtgttgagatgtgcaagacttaaggtaaccacaagctgagagaggagcagaaacatattaagaattctctaaataacagtattaaacaaaataatgttgaagcccagaacgtcagagattttctttataactccctcatatgaggtgaaataacctacttaaggttgttcaactggttgtgtggcctactaggttagaccatcagagacagtgtggtcctccttggatgagttgtttaggagaattatacatgatataaagaaaggtcacagccatgtgttagaaaccgacctttgtgcattactccttctgcaggattccaggggaagaaaaatcaattgctgactaaatagcatatttgaattacagagatcagcaacagtataaatattgcaggaaaatttatatataaagaaacttctatgtgcctttattagttttgtccacacaaaatgaaacaatgtgtgtatatatatatttttttcaggcaagcacccaattgaatttcagaaatcagaaaacaaataatttaacctttctttttaattcaattatattgatttgccaaagaatcactctctgataaataattttaaagtgtcaactctctgaatattgtaaaatatgtaattttgggtaaatttaactacatattcttggatccttaccattttcttctcttgaatataaaagatttagaatatgtcttgatgattttttgcttgttgtaattaaaatgtcaaacttaaagttgttaaaatgtacatctctctgatactagtaattcttttctcttttaaaaaacatacttatccagtatttaatttcatatgtctagatttgcttaggcaaaaggtagaagtgcctgctcttcagtttgcacataagctaatatagtttaatatatataaatgaatgtgtataatagaagtatattcataagttagaacgtgacatattacctaacataaaacaaataaaacagataactcagtagtttgaaagggaagcttaagggtaatactatacatatagtgtcataacactatcatgaaaatctctgttaaacgctgtctcctcaggcacattctgttaactcttcctaccacacttgtcacattacccagtttcattttcttgacatcacccagggccctctgaaagaattttctgtattaacatacttgtttaatgttccactgtccatataagaatgtaaactcagtcatagaagatttttttttcttgttcacttctatatcccgagcatctcagaacaatacctggcatatgaaagatgtttgataaataccaatgaaattaatgtttgaatgaatgatagcatttctgtttcgttgtatttttcattaaaaaattcaagtttctctcaactgatttcagatattccttcttttctaacatatgcatgcagcactatgaatttccctctaggtgctgctttcactgatccccaaaactttgattattgtcatttgttcaaaagattttaacattttttggaaatgtcttttttgagtgtggattatttagaaatgtgttatttaattgcaaatacttggagattttccaggtatctttctgttgttgatttccaatttaattccattgtggtctgagataatacattgaatgatttctatccttttaaatttgttaggttatgctttattgcccagaatgtggtctatcttcatcagtgttccatgtgagcttgagacaaatatgtattctgccattgttagatggagtattctataatgtcaatgagttaaaaatgattgataatgtgactcaggtcatatatgtccttaatgattttctgccattttaatctactcattactgatgtaggagatgtttaagtcttcagctataatagtggatttgcctgttttcagttctatcagttttggcccgtggagcttgatgtgctgttcttaggtgtaggcatgtttaggattgtaatgtcttcttgggaaattggcccctttattaagtaatatacctctttattactgataactttgcacatttggaagtctgaaatgtcttaatacattaatgatcttaaataaactaaaactccagcttgcctttcgagcactgcacagtacagtagtttctgatctttctgttttgcctctcttagtgtggaatctctgccctgcaaatgagctgagtcccgagtgaatcaggacccacgtattctgtcctatgaaggctgagtgcaagaggagattacctcaacttcttggttgcactcacagtgattttgcttcttgaaattggaattagaaagaaagagaaatgctagcaaattgctcctcctaatgagttacggtaatctttgattgggaaataaagctagagagtgccccatcttcttagccatatccattagtaattgagcttttgcctagttgagctgtgtggaaggttgtaggaggaaaggagcagataatggttcaaatgccacagactcccactattctaactgaattttagtatgttttcttgaataaatgtttcgttcacttactatattcctttggggcaattttcaggtttgtgtgtgtgtgtgtgtgtgtgtgtgtgtgtgtgtgtgtatgtgtatgtgtgtgtgtgtagtttttaaaaaactgatttcacaagttttgcttgtttcactagggaatggtccatagagctcatcatgctgtcatctcaaaagtggatctttccaactttcctttgattagtgttagtatggtatatctttcttaatcattttgtgtgtaacatataggaatattcatgtttaaggtgggtttcttgtacacagcacatccttgtgtcttgattgtcttaatccattctgaccatctctattttttaattggtatatttagactaggcccatttattgtgattattgaaatagttgggttaatatgtacatgtttgcaactgttttctatgcatttgttctttgtatatttttatttcccctctttttctggcttttctggctttgattgagcatttatatgatccattttatcttctctcttagcatatcaattatacttctattttaaaaaatcttggtggttgccctagtatttgaaatatacattattagctaatctaagtttatcttcaaataacagtatactgctatatgcatgctgctggtactttataatacagtgatctcaaatttttcttgtattacctatgacactgatattattcacataatttaccctcatactatatttacctaatacattgttactattattaaaattagcagttatataatataagaataataaaaacaaaatactttaccttcatttatttcctcccttgatgctcttcctttatgtagagccagatttataacctatattattttacctctgcctgaaaaaacatttcacatttcttgcagggcagatctgctatgatgaaatccctcaagttttgtttgccagagaaatgctttatttcttcttcacttctgaagtataatttcagtgaataatgaattctagattgatgttttttctttttttattgttacatgatagatgtatacattttaggggcacatgtgatgatttgaatacattcatagaatcaaatcaggataattgggatatccatcaccttaaatatttatcctttctttacagtaggaacattagcattattcttctctagatattttgaaatgtataatagattaatgttaactgtagtcaccctactaatttatcaaacaccaggccttatttcttctatttatctgtgtatttgtacccattaatcaacctcgcttcatcccctcttaccccaccctgcttggcctctgacaaccattaatctaccctctatcttcatgagattcaattttagctcccacatatgagtgaaaacatgtgatatttgtcttcctatgcttgtcttattttacttcatttgatgacttccatttccatccatgttgttgcaagtgacaagatttcattcttttttatggcagaatattaatctattgtgtatgtatgtgtgtttatgtatatatatatatatatatatatatatatatatatatatatatataatttttttcttaaccattcatccattcatggaacttagattgaatccatattttggctattgtgaatagtgctacaataaacataggagtgcagatatgtctttgatatattgattttatttctttggggtgtatgcccagtagtggaatgctggattatatgatagttctatatttagttttttgaggaaactccatgctgttttccgtagtggctgtactaatttacattctcacaaacagtatatgaggttttcgcttccttcgtatcctcgccagcatctgttagtccctgtcttctggacaaaagctattctaactggtttgagatgatatctcattgtggtgtttttaaagtaattttaacctttattttagattcagggggcacgtttgaaggtttgttatatgggtatattgtatgatgctaaggtgtggggtacaaatgatcccatcacccagttactgagcatagtacccaacagttagtttttaacacttgccctccttcctccctccttcctcgagtagtccccagtgtcttttgttgccatctttatgttcatgagtatccagtgtttagctcccacttaaaaatgagagcatgcagtttttggttttctgttcctgtgttattttgcttaagataatggccgccagctgcctctacattgctgaaaaggacatgattttattcttttttaatggctgcatattatgccatggtatgtaacattttctttatccaatccaccattgatgggcacctaggttgtttccatgtcattgctataatgaatagtgctgcaatgaacatacaagtgcaaatgtccttttggtagaacaacttattttccttggggtatatacccagtaatggaattgctgggttgaatggcagttctgcttgaagttctttgagatatatccacaagctgctttccacagtggctgaactaatttacatttccaccaacagtatataagcattcccttttctctgcagtcttgccaccatccattgttttttgactttctaataatagccattctgactggtgtgagatggatgtatctcactgatgcctgttcagttctcaataaatctcagctattgtattgttaacagtaacaataatgtaattatgaatcccagtgtaaattatttgatatataaacctaagataaagacatttattcaattatacatatatgaaatttgacctgatagctcttcatgaaacttataacctcttatctggaattattgtgatggtaaagggatcaccattttaaaatatatactcagtgatattttctagaaatatattataagcaacaattgtataaggaagacacaggaaaaaaaatcaagtttttcttatgaccaatgtcttcccactctaccatttctaagacctcagatactggatttcatgtactgtaacctatgagtcagtaaccatcaactcccaatatcatttcatttgtagtaggtccaccatgtatcaggcagacctttcacagtgatagatagtatacagaagctaccatgctgagatagcaacagtttgccataatctcatgaaacaccactaataggagactgctggcagagtcaatataatgcataatgtgcttagagacatttctgaaccaattgtaccagtcatacatctagcacagaatagataagtaaatggaaatattgactttgacacaggagacatgttttaaacaagaatacccaagctggataagatttgaggtcaattttggtaacttttaaaaatatccctgtctaagtattgtgacttttgtcccaagtgcacattactagtcactttatcttaggatacaggcaggtagctaagtaattaattcttaccaggcaggttctgctaagcctcctctggaagatgacctttttaaaatgttgacctcacatatagctgaatgatggatgtgtcacttactggcaagctcttttctgttttgatggggagtgtttaagatcattggacttgtagtccacctggtaaatggtgacaggattgtgagtctggatatgattgagcagtttagtaatatatataattttcatgactgtctgaaatctctagacaccttttcacttttgatcatgatttcaactgctgccgcctgaattacaaatcaaatgttagaacaatacatcatgatgctagaggcatagcttaggcatgccagcaagccaaatattgagttttgtgaggggggttgtgaaagacaactttttacctatttggaactaacttgaaagcatagctttagatttacaaaaatttaaggacacggggattgctattttgttaaggcttgtttagggacattgaaccttaaaagtctcaattttgaagaagtagtgattaatatcatttgggacaaacaaagattttagagatgaaatggtaggtgaccttgaatttgtaatttgtttgcagtgtatcccaattaagagcgtggaaaatctctggttaatatcaaatgtaagtactctacattgtaaaactggcagtaaagatgggaacatctctgtaaaatagttttatcaaatgagtggcttagtgtaagaatttgatttaatttatatatatacattatattttatatggaaatacaacaacataaatacatcaaatgtgctttcatcttagactctgaaaattggttaatgcctgaaaatttctgaagtcctggttgaggtttgctgtttctcaggtgacttagggctaaggatttataacttgattctaataaattctgtatgtaaaataggttaactttatttaaaaggtctcatgaaatttttaagtgattataggacttacacttaagttcctgagctaaatttcttctgtcttataatctgactgatgtcttcagtatgacctctagcttctgaacgtccattattttttctcccgtacactctagtttctctagtactatcttgagaaattacagaacaggtatttgtgaaatattggaagcatgtacatagttcctgtgttattcatattggggatcagtaaaagtattttaaagctagatgtcatagttttattcctctgtctcctcgatatttactccaaaaatgcaggaactctacaagaaccatggaagcatgctactatgtttgtgtttatatgtgagttacaagtcagtccctccaaacacccactccccaggaaatatacctggacatgttcatcatcttaaaactactctgatattatactataaaaataatgaattattcccttaaagaagtatagatgtgtctgagaaaataaaaacccatgaatcttcggatcctttaagaattatttttttggaatcttgatatgtcaagtgattcaaaatgtttgttatatatgtgcatgtttgtgtgttgcagacaagataattatatggagcaagctaattaatttattttttcttattaacaatttcttcatttactgaagggtgttttaaggtaaatatctttattacaactaaaaatgtactgaagaatatgtcgtaatattagcaagatttgcctaagcctgtataaccaaattggctaaaacaaatatatacactcttaagataaactaaagtgaagtttaagccatacacatattgttatgaagtctaaatttttgtaataagaaataggaattcatcactggcaagagatttttagttgtaaatgcttataaacattttgcaggtatttaaaatcccatttagttatataaatcattctgtggaaaataataaaattgtgtaagatcagaattgttccagaaacctaggatgcaggttactttttaaggataactccagaggcaaaattaaatatactcattatcaggttttatatactcattaatatatgtatatgtaacattaagaattgcatagttttttccatttataccaagggaaacaaattggagcttttaaataaagtctttgatttattatattttctccccacagataaagaacttttgttctatttttacctttgtgattactgcataaacatagtgatatatatatatatatatatatatatatatatatatatatatatatacatgtactgtatctacaaatgaaagaacatttaatggaattaagatactttatcagagaacagtctatgtttactctataaaatactacctactcaaattatccttttatattctcaatataaaaatgatgaaaacaaaatctacaaaatgtatgaagataaccatttgggggttttgtttttagtttgttcaaatggatactttactccactgtggaaccagtgggttttgtccctgatgtaacagtgatatttatataattaaatgactatttttgaaaatgaccctcaagataatctatacctgcttcttccttataagtgaggaaactgatgtctgtgacgatgaagtgactgacttaacggtatgcatctaattggttgcagagcctggattaccacttttgatgtttctcacttacctgagcatcagtgacatatatcatttggtgcaatgctggtttacaccactcactgcttcatctacctgccttgttattcaaataggaacaacacattatatcatgggattaatacaaatagtaaatgtacatattagtcaggaaatcagaaatcatttcaggttttttaagtcggaagagtttcaacttaagaaattagagaactacataaccaatggaaaaactgaaaacagagaggtcagggaagctagcatttgagttcacgaaatcagaatgttggatgatcaggaagccattgctggctatatgtgcaccaaagtgggtggttcacaggaggagctcactcaggagctgccacggactcctcatctgtcatctgattttgctacagctgcccttggaaactaatggcccatttttctctcaacccccaaggaaagtacaaatgcttcgagttggctgaaacagttctggaatatacaaggaaaggagttacagaaaatgtagttacaggtttccccttgtgatagagagtacaaaggggccgtaatgatgctgagttgacaataggcaacatataaaccagcatgaaataataacaccggacgctgtcaagcacagagaggtgtttggtaaaaaatattaaaagaaatataactaaagccaatgcctgcatttttaaaagaacaaatttaggacaaattgaaacattttaacttgatttgaaattatctaaccaggaatggttaggcatttacttgaatttagatttaattaatacatgcacatgtatacatataaaagttggagaagtttcatgatagttcttcttgtttgtggggtgtttgtctgaacattatctatatttactttgttcctagatttttttaatggagaatatccattcagtataacattcaaaggttcttgggattaggatgtggacaaaattgagggtccattactcagcctacagcagaaattgtagttccagtaacagtatgtaaaattacaaaaatcttttaagtttcccaaagacatttctcagtgtactagaacactttctaagcagtattgtcagtgtacacagaaatgcagatatgtatggtaaagcagtacattgtgatgtgggttatttggacttgagtcattttgcctagacaaaaagaaacttttttcctttgcaagtaatattaccaaaatatttcctagcctcatttgatctctaagcttcaccacacccctggctttcttcagccctagtgtaaggtgagtaatgggttgtgcatgtaaagataatgcgtaccacggtgtaagggccagaaattgggtgaagtttactgatggaaggggttatttcttacacattgcttcagttagcatccttttggtcagaagaaacaaaatctaaatcaaattggcctaaattatgacagagatgaatatgtttattatttaaccaatatacacagacacagggtcggctttaagcgtggttcatagtttgagttagaggttttgatagcattaggtctccagcttgattcctctgtgattatgttggctctgttccctgctttcccctcccaccatccacttagtttgttttggggtgatatacgattgacttggaagatactaaactgtacacaggaagggttccctcaaagagctcctcatcatgtacattccagaactctcctaaaaaggattcatctgcagtctcatagtaccttgtctgcagtttttccttaacctcctttaaatcaaattttatattagttctctgtgtacacattgataatgacttgttaaaccagggtttagaaagcagttgcctgtggaacacatgtggcccacagcgtgtttttgtgcagcccacaagctaagaaaagtttttccagtttttaaaaggggtgtagaaacaaaaggaaaggaataagtgactcagacctcatgtggcctgaaaatcctaaaatatttgctatctgaccttttatagcaaaaggttgccaacccctgtgttagactatcagatacaaggaactgtcttattcctgacacattgctgttgtgcctaatgcagttgtttccacatagtgctgtcatccttaaattgttcttcccatctaccctccttggtcaagcttttctgtttcattcggggaggacatgttgccatgggatatcttattaattcaggaggggaagacttgtgggagatggctggtggacatagatgagataaaaattctcaccaatgataaagtatctgggaactaaaaggaccttgaacaatgccctgtccaactgcatcttgctacagaagaagaaataaggacaagggatggaaggggtgtacccaaggccataggtcataatcagctgctaaggcatcatcaggaccctgcatcttggtccagtaccacttccaccaacccctgttattttttgtgacacaacatcttttccttataaccaactcagatatataccaagctgctgtatccatgcgaggaccatccgagactgttcttttaacccaagagtttcccagaattccatagttactgctgaaaagagtgagagtgatcaagaactttcttaaaaggattttctctttcattgtgtttcattttcttcaacccatctcataatacctcttgagatttctatagtcctttaatgctatgtccttgttccttcccggtagttatatttcaatggccctagcttcaagatgtctttggctgctttctaggagatctcgttgatattatctcatttatttattgaataaaggtggtgacaaaaatgtaccagatcttgacggtaacttatgtgattgttcattcaaagattgctaatggcctgttaaagcccttagatttattaatttcctcatatctcattctccttgattgccctctcattccaactattaactggctttgtaactatagctattatggtacttcagtctccaacttgccttccgatttttctgatagctccttcccccttcttagttctaattttttcttccaccacctaagtatgataactcttagtatatttatttcctattactgctgtaagcattatggctaagtgacttaaaacaacagaaatttattgtcctagatttctagaggtcagaagtccaaaatggggtatatgggttaaaattaaggtgtcagcacaactgtgtacttttggaagctctagggaaaaattaatttccttgtcttttctagcttctaagagaggcctgctttttttgccttgtggctccttcctccctcactccaagctctgtttctgtaatcacatctcctttttctgactttgaccttcttgcctccctgatcacattgggaacactggaagaatccagaataatcttcccatctcaagttccttaacttaatcacatcagccatgtcctttttgccatgtaaggtaacatgttcacatattctaaggattaagatgtgtacactttgggggccactattctgcctagtctacttagattgccaccattggatctcagttgcattttatttttcaatcttactggtaccctctgcctgtttaaaaatgtaaattgttttacaaaagtatgccttgattcataaaggttatttatttgcatttcaaacttgttttctgtaaaattattccaatcgattcttactttaatttacctacacctcaatttaagctcctattaccacttgaattgattccattcaaataatatcatttgaccccctgatttcatcatctggaccatctgggtactccaaaagagtaacctaaattacttttcaaagtttttccctttactttatgtattctcaacatactttattctctcccattgctatgctttttctttggtgtctgaaattccttctttgaaaactctagtcagaatttcttatcattattcaaggtctgtatctcaatggtgacttcttcaaattaataattatttataccacaaatcctatgtgtctcaaccccttttaaattctgcccttccccctattgaattttgttattgtatctggcagtagtcatttttctttgctttgtgttttatgtaactgtgtagtgttctgtcctatcctcctaccacaccacccagggaagagaaaacacatcctgcccagattcatatctcctaagtcctgctccgatgttttgtacatcaaagtataaataatagcattactgtgatgttatttaaaattacactgtatgtggctgtgctgatttaagatatgtgttgaagaattcacctgccagccaactatacctaaatgactgtctcctgaatttatttcattaggagactttttctgattttaagaaacaccttctggcatagcttctgagttatttttgaaaaccctattatagttatgttggatagatcaagtaatccagggtatgttatgcaacataccctttctgtatttgtgtattcattagttgcattcatattgactgagaaacactgtgccaatgttatgaagggtatgcagatgtgtatgccaaggtggctgtcttctaaaagcttccaggaggatatgttccactgtgacttttccaactacacaacagcagaattctagcatttagcatgtttgtgaaactcctagaggcaattaacacattatgtgacagaacctagctccttaatggtattaaaaatgcttttttgaggccaatgagaacttgatatacagcaggataattctttagaagtatcttttatttgacatttattagaaatgaagttgtcatgaaaaggcatggatgtttatatgctgctataagatagtcatctcagcaggcattttgatcagtcattacctttgacagagaatggcacaatagcatgagagcctgcagagctttctttaaagatggttcatataataggggcatcgtgatacttggagtattaatccaatattgagggaaattccgtgcccctaatgcttgaatatctatgcagattttggaatatgtcattttcagtagctttgacagatatgtaaataaccatttccccaaacttcataattgcccatgtcattaatttttctttttactgttgcagaacattttcctctttacactcaagaggataaattattattgtggttccatttcattggaaagcatacacctgcatatttgagaatctttaacatttgaatgtataatatataatataattaagtaaatcttcaggtattgaaaatgtacttttgaataatcacgttggcctcctgataataagcagtgaatagtaattgattagattagtatgctatttttttgaatatagtagcagtgactcaataaggtttaattgcattcctgtaaacatatggatggttcaagaattacttctttgtaaataatataaattggtaagactctgaagtgaatgacacagatttgatatagtaagacatttgaatttcagcttctctgagcactgatactatttcatcattgaaatacaaaattatggaaatgctgaggaagaatgaatgcttatttataggcacaaatcaccaatattaagctgttatcaaaatctttacctaaatttgttggttgcaaagttctgtaataggcttaaaaatgtgcagtgttcagaaagtaaattcttatttgatttgccagatgcaaataatgtatttgttacgttcattcaattattaaagaaaatttatatcattcttcctatcttgtagggttgatatatattacttggaaatgtgagacaaacgaaatgagtgtaaaccctaagaatatccattggtggactaaaatgtaaattttaatttctgtattctcatgtagcttaactagcatttagcatgtttgtgaaactcctagaggcagtttccacattatgtgacagaacctacctccttaatggtattaaaaatgcttttatgaggccaatgatgtacaatgtacaataatgtacaatgtttatatacattgacttgctaatttattaagtatccacattttagcctcttagacctactctgaagttgacttaactttcaagatgaacagtcatttttgacaccctgccatccccttgcaacagagaaaggtatcctgatttttgtgattctctggcacctaatagatgcctcagtgatatagtgttcttatgggaaggttatattgtattttaaaacatgaaaataccagaacagagtcaggatcatgaagccaactctttaggggggtacattagctggttctaaaaccttttacctgtagaatccctattcttgctcccagatgctatattgttattgcagacatggatgttttagctccgttagcactggagacaagcttccctacaccatagtagtaatatagggagagagaaccagtacatcttgtgtgaaagtttctttgcatattcaagtagtttcagaggcagcccaattataagaattaggtctataatcttaaatatgctgtaaagatcattaattatctgtgtaaatattggagaggatcagcatggataattaaattgaatttatttgaacataggcagttttcacattggctgttgaagttgctatttgtgcaaaatatataatttactataattaggacactttctgagaagttttttttgatgtgccatattttcatgctcagcagaaatacatataaagcataaatattttcttcagctacatatttttatttaaataatctccattattttaaattcctaaacatttatattatttaaaaacctgaactaatctcattcttaactaggtttgtaggctgggagtgtcagagctatgtataggaaaatttgctgtctttttactcattagtctaatcaagactagaatagactacgttgagtgtttactcatattacagatgggactaaaaatagaagatttccaaattacacatttaatatgaaacaggaagtgattttgatgtagactatgtaaaagttttcttctgactttattaggttattttttaattcataaaaagaacccccaattgtcttgatcttttttctaaaatttgaacaattaaattttacctttacctacagtggctgtgaagaggatctatattacgtggtagttatttgtacatttaattaatttctcctgtcagtaggactgaaaagttttattcatttatttgtacttacagcaaagataaagttagagaagtaattaaaatgtgggttgttttgctttcccacaaatattgaatgtcattgacatttttgtatctcttctgttagcttaattaagagttgaattattttaagcaacagttgtatgttttagtcattctaaaagtttaatctacctgtgaaaatccacttttcacctgcggtattatgtcaaattgttttctctaataacacttttataagtacagtttatctctccttagcagtataattttgcaaatgtcttgaaagtttctgatttgtatgtgtctccactagtttactcttcttttttttgacctgggactagatcttagaatggtctgtacatttagtaatactcatcattttgctacttttagagctacatcctggtttcattgtcgtaaattgaaagataaatttagaattcatcttgccaatgagttcagacaagaagaacatcaaagtcaacatttaatgtgaggaaattgaatataaactagtacttttcatgaaatcgttatatgtgaacatcagtctatatgaagtcccatctcagtgaaatatctaacaaagtatggcctgttaatagtttcactatcatttcaagtaattttaaaatataacacgtttctagcattataaaataatttagaatataaaaggctcctttccatgtgcttattgccatttgtatattttctttggataaatttcttttcaaattctttccccatattttaatttggttgacttgagagttttttttagttgtccctagactatttgttgaaaagattattatttcccacattgaattgtcttgttagccatatcaaaaatcagttgactgggatttctattacctcaaacattaatcgtttacttgtgttgggaacattccaaatcttctcttctagctattttgaaatataaatatgtacaactattatttatcaataaaaaatcaattgactataaatgtgagggtttattttaggaccaccgatgtctgttcttttgttcataccacacactcttgattactgttgctttccagtaagttttgaaattgggaaatatgagtcctccagttttgttcgggttttcaagattgtttttgctattcttggtcgctggtaattccagatgaattttaggcacatcttgtcagttttggccaaagcgatgctgagatgttgaaaaggattgccttttgatagggattgctttgtcaatcaatatgaagggtatttccactgtaatagtgttaaatcctttgatccatgaaagtggatttatttaggtctttaatttctgttaacaatgttttgcagttttcagtatacaacttttgcacttcttttttaaaatttatccataagtgatttattatttttgatattattgtaaattaatttgttttcttaatttcattttcagattgctcattgtaagtgtatggaaatcaaattattctatattaattttgaatgctgtatccttgctgaacttggtttttagctctaataggtttttcatgtatatgtatagattccttagtattttctgtatataaaatgatgtcatctgttaatgcctatagtttttcttcttttccattatagttgcctcttatttctttttcttatctaatttccttggctaacgtctctggtacagtgttgaatggaaatggtgagtgtggaaactcttgtcttcttcctgatcttaggatccagccctttaccatttagtatgatgttagttatggttttatcatagatgccctttatcaagttgaggaagttcccttctgattccaatttattgaatgctttatcatgaaagggtgctggaatttttttttttttttttttgagatggagtcttgctctgttgcccaggctggagtgcagtggcacaatctcggctcacttcaacctctgcctcccaggttcaagcgattctcctacctcagcctccggagtagctgggattacaggcacccgccaccatgcccagctaatttttgtatttttagtagagacagggtttcaccatgttggccgggctggtctcgagctcctgacctcatgatcctcccacctcggcctcccaaagtgttgggattacaggcgtgagccaccgtgcccggcctggaattttttcagattttttttttcatcttttgagatggtcatgtggttttggtttcttattcttttaatatggtgtatgacattgattgaattttagatattaaataagccttgcactcttgggaaatattcctgttggtcataatatatgctttttatatactgctggattctatttcctattattttcttgaggaatttgcatttatatttattagggatattggtcagtagtttttacttcttgaattgtctctgtctggttttggtatcagagtagtactggcctcatggaatgaggtaggaagtttatcatcatctttgatgttttggaagaatctttgaaaggttgatgttaattcttttttaaatgcttggtagaatagaccagtgaggtgtgggaggtttaaattttatttgtgtcaagttttaagttactgatgcaatgcctttacttgttacaggtctatttacattttttgtttttgttcttcagactgaataagttgaattaatctattttcatgtttgcagattctttcttcttccagctcaaattggccatggtgtatctctggagaattttttgctttagttgttatactttacaactccagaatttaaatttgcttcctttatttaatttttatctctttattaatattctctggttgatgagatacaattattaagctgtcctttatttctttaactatggttttctttagttatgtgcatattcttgcaatcgctgatttcaagtctgtctagtaggttcagtacttgggctccctctgcaacagttattattgatggcctttttcttgtgtatgggctatacttttctattttgtgtgtatgtgtctcaaattttttttgttcaacatgggacactttagatcatataacatggctactttggaaatcaagtctgtcctcctccctgaagctccagggtttgtgtagttgtttatttgtttagcaactttccttaactaattttgcagagtctgtattcttttttaaggcacagccactgaaatatcttcttggctaattcattgctcaggtaatgattgagaatttttaaaaatgccttgaaccagtaattctcccaacctttgcccagggtttctctctctctctctctctctctctctctctctctgtgtgtgtgtgtgtgtgtgtgtgtgtgtgtgtgtgtgtgtgtgtgtgtgtctgtatgtgtaagcacattttcaatattctggcaatttacaactctgccttagccttttcttccaacttgtgtagaggtgggagattaaggtgatctcacgtcttttctgggcatgactatagctctgaacttactcacagcctactagatccccagaaatatttcagagctttgcaaggcctcctatgaccatctcattttatagatttttcttttacattttttgtctatcttcttgtttgtcccatgtggcttcaccacctaaggcagctgcaaggctaaataattgagactgatagtttttgccatattagggatagaactttcctcattgagcaaattctgagtcaggtgaaataaagagaaattcttgaatggggtttttcagccagctaccagagagataaaatagtagtagttctctggggatggagctttgtgacgagctccaaaccagtttgtcctctttattggctcctaggctattgtttttttcaaggctaatacagacttggggaaagagggatggaaatagggaaagttaaaatataacagtgtttgttatttttactaaaagtcagccatttttcttgaataaatgctgttcagattgttgctagattttgtttaattttcagagttctgaaaaagttgattttgataattttctggatttttttatttcatggaaacaagaatttcagagtttcatactccactattccagaagtacttctcattttaatatttttgttttctttatgatataatattttgacaatttttgattactttgtacttaactttttaaaaaagctattaatggtttcagttttttaaataattacaatagtgcttcatatgcttgaagtacttattcttttttattattattttatattgatataataattgtacgcatttattgggtatagtatgatattttgatacatgtgtacaaggtgtaatgatcgtcagcgtaattagcaaattcatcaccacaaacatttatttctttatgttaggagcattcaaaatctttcttctagccatttgaaaatatacagtaaattgttaattctagtcaccctgcagtgctatagaacactggaacttattcctcctatatcaccgtatttttgtatctattaacaaacctctccatatcctccctccctcctacccttcccaacctttggtaatcactattctcctctctacttctatgagatcaatgtctttatttactcgaagtactcttaaaagtttaggacttaagtatttgaagaaattcacttgctttttgtttttattctactcaatactttttaatataaagatttacagtcccccaaattctcttttcagaatcttaatataattattcatttcgtcctgaaaactgtttctttccaaaattaaacatttgttgtcatttaataaaaataaaccagaagtagaagagctggaaaatccctccaagttcatctgaactggagaaaaatcaagtctaaattactaaatattttgaaaagtacagagttttattacagtaaactttgacaagttgcctttatttggaaaagaaataacctatttttctatattctattttagagaattaaaatacatttaaagccttatattgggttggtcaaggttttttttttttaaaaccttagtagtttatttttgtattcaaagtatcttccagcatgtctgttaaatttcttatttttttcaattttttttttttttttttagattcagggggtacatttgcaggtttgttgcctggctatattgtgtgatgctgagatttgggatacaaatgatcatgtcatccaggtactgagcatagtacccaacagttagtttttcaaccctccctacccccttagtaggctctagtgtttattgttaccatctttatgttcatgagtacccaatgtttaacttccacttataagcgagaacatgtggtacttggttttctgttcctgcattaattgacttaggatgatggcctctagctgcatccatgttgctgcaaaggacatgatttcgttattgtataaaaaaccatacagctgcatagtattccatggtgtataggtgccacatattccttatccagtccaccattgatggggcacccaggctgattccatgtctttgctattgtgaatagtgctgtgaagaacatgagggtgcatgtgtctttttggtagaatgaattgttttcttttgggtatatactcagtaatgagattgctgggtcaagtggtagttctgttttaagatctttaagaaatctacaaacagctttccacagtggctgagctaatttacattcccaccaacagtgtgtaagtgttcatttttctttgcaaccttgccaacatgtgttctttcttgacattttaataatagccattctgactggtgtgagatggtatctcattgtggttttgacttgtgttcctctggtgattagtgatgatagcacatccctttagatcaataccaattcaatataattcaaatatctatatttactgaatgttatgatgtaattgagtttcttcacaatctccacaatcctttagaaaatttctaagctttaactaccttctatagatttcatgtacaacatgtaacataataagggatagcagatgaatggacataaaaagcaattgggccttttccccgatatttcatgtgcaactaatgaaggagaaatagactttgatttaaaatctactggtgacttttatgtaatgtagtgggcttgagaaactttcagtatttatgggttcaaatatcattttataattttaataatgcatttatgtaaacattaagttaatgttttctgaaaagtacagcatgtatttaatgcaataaccactttcaaattatttattgaggtgaagttttcttgtaatgaaatgtagatcttgagtgagtaattcgttaagttttaataaatgtatgcatatgtgtaactcacatcctgattaaaagattacatttctatcactccacatctttacttcatgctccttccagccatttcctaggtacacaccaaaggtaaactacattctgatttctattaccatcaattaattttaactgctctagaacttcatataaatggaattataccgtaggcaatttttgtgtgtatcttcatttattaaatttaatgtttaaaaaattcatccctcttgttaggtatgttggtttttcatttttatttctttattgagttttttcacataaatacacagtaattttttattcattcttttggaatggagatttttttggatatggcttcaaatttgggactattatgaagaacattcaggctatgatttttcaaaaggggcatgaagtttaaacaaaaagccttcttataattctgtagaaagtgggtaatgtgtgagtgtgtatattatgcattaatatgcttacaaaaatgatatatatacacacatgctaaatgtctaataataatagtaattataatgacaagtaacatttgtttatgttcgctttgagctgggctcttgcataagtactgtacatgtttcattccatttactcctcacaacaatttgtaaagtaggtaaattaccatattatctctgacaagtagactgtgcattttggaggataagtgatttgcctaagatcatgcgcctagggagcggccaactggggatttgaaatctagttcttacactgtcaggcattgtactatgcctgctacttcctaatagttaacattatttgagctccactgtgtgccaaatatctgcatgacacacacaaacacacacaccgataatacagtgtagaaagataatctatgtaaagattagcaagggtgcagtggaagaataccccacatagaggtcatttcctcttcagaggattaaggcaaaggccaccaaagtgacttattagaggcagaagccagtcagaagaggtataatgtttgacctacaaagggcttaaaacttatattctgtttgttgccaacatttaaaaattaggatatcacgttaatatctggatttctggcatcctcctacacatcatgatatctgaaaaccttgcccattgccatggtctgaagctgaccctcaactacttcccttgggcctgcagccagccttgatggcttatgctttctgaagagaggaatatgagtttatgaatattaaataattttttgaggagtggctttaagctttaccttaaagaatttcaatagagatttccaggctgtgtgagggaatagtacaatgcaaggaaagaatggcacttgctgggtgagctgaaggaataggaattaggtgggaactatctcgattgcccaaaatccagcacagtggggggaactaatcagaacataagatctgaccttaatatcttaggaaattctatgttttgaaagcttttatagaggaatgacaaaatcagagctttaattttctaacaggccaaatgcagcctaaacattgcttattccagaaactgtcatttaagtgtggttatttgaattgaacatataggctgaaatgcaataaaccgccatttttgtaggttaaaaggaataaagtatcaagtacatgcagtttggcattacaagtttgcctagtagcactttaaatgagtcactaatttaatatattatttcttttataaagttcatttatactttctgaaccaagacagtggagctggtacaaatatacactgtaatgcctccctatttgttgtttcctttaaatctttaaaatgtgtttttatatttgttttttgagatgctgaatttccataatatttattagaatattatatgtattgagatgatatttccctatgttagggagaaaccatttgtgttatataaacaaacaataaagttgtctaaaaatagaagatccttttggaaatgttgatgcctaaaagacaaaattatgtggatgaacatacgtaagcttcagtgagcttttcttgtactaggcatttagctgtcttgcaactgttaatcagcacaggccttaaaacagctgctatcagattaattagagggaatccaggaaataattcaactgaatgtagcattcatgtaagtgtgttgaaggcaattaagagtaactatagtcattactgagacttccaggaagtatgccaaagggcttgaaagttataaaatgccttttgcttcccaattttatatatatatatatatatatatatatgacagagagagagagagagagagacagacagacagagagagagagtccatatataaacacacactaatagcaattaaaaataaataaaattgaaaagcttgaattacagggtgttaactcacttctctctttgaaattaaggggccaagggaaaacaagaccatttgtctaaattcatttagaaagaaaaggatttatttaaagatgctgtggcagataaaattacgtttcatttttgtaatcctagttttcatagccaatgaaaggcttaaaataaaggaagttgatatttcaccaaggtcacacgatctacgagaaggaaacttaagaaagtttcctaatgcgggatttaaatccttaaaaacttgctgtggtcatcatcggcatcatcatcgtcatcatcatcaccaccaccaccaccaccactgctgccattaattattattattatcatgacacaaaggttgattacctggcatctcatctcatttctactgttcttaggtttcttgcctgtcttactgaatgacagtatgttactcaaaactcagcatggcaaaaaatctgggttttttaaaaccaattttgcctgtggttggcaccttgaaaaaaaacgagagaccaagaaagagggagccgaggatgggagtggaagataaagatttaaaagaataagtattgatattcttttctctttatttttaagtgacaaaacttatatatatttatggcattaaatatcatgttttgatatgcgtatacattgtggaatggttaaatcacactaatataggcattacctcacatacttaatatcattgttttgctatttaataggtctaaaagctgaagtcagagaactcatttatttatgagaattttggtgtgcaactgcattttgctatgtgttacagtcttttaacctacttccaaatctcttcttaaggatgagctagaaggagagactggctgacactcctcatttttgaagccttggcttttataaaaggggccttcagtgtagcaaaaggcctacttataattctgtaaaaagatgttcatgtttttcaggaacgtttgtctctatttagaaaaaataaaatgtagtttgggaatagcggaaatgattgattagagtgttacacatgagacaaaaagatagatgggcaataccgttcctgtgttttcatgccctgttcctcataagcaacagggcaagagatgataattcccaggagaagcaggagaggcttctggatcatgaggtgctattctcttacagaggtgctaccacagttactaggtactcattccacttcttttttttttttttttttttttttttgagacttattttgattaccaggcctctggtttaccaagtgtcaagcccaccacggtcccatcttttccttatctccctcttcaatattcctgtctaccaccacccttccctcacccacatagcaataccacataccatcatttttctccaagccccatctcttaccccttgcaaactctgccattgttttcatcccagttcaaatttcctccacacaataaaatgttctccccatactgtgacttccttgaccttacgttttcctaggtgttattatcttcaccaaatcactaagtgtagattatgtatctttgagtgttcatggattcatgtggttagctctactttagcacgagaaacaaatgccctggaatcactctaggaagaacgttagttgctatgtggaaataaggagaaagaaatattttagggatggaaactgtatcacagaacttcagtttttgaaaaactggaaggagtcttagaatccatcccgtctaaacccctcatttgagagttctagaatctgagagccagagggcttgcacatctggtaagtaatggagtatattcttttgacagtaagtactaaaaattaggtcttgtaattccctggccagtatactttccacaacactacacagaatctaagctttggcttatattatttgaacaacttgaacaaaaatgaggtaccagattttgacagctggaaataaccggaagtaaaaggggttagtattccccaaacaagaaatagacgaaacaaagatgcagaaaagagaaatgagtgtggtcctgttagggaagaacatatgggtcagtacaccatatagtaccaaggctgggtaaaaggagtcttggtgaaggcaataaaaggaaatgtttttctgctaaagaaattaaaagtaatattaaaacaaactcgggtttttgtcttccttttttttgttatcaccatgacctggcaattgcaaacaataccagtgataaactattcctccttgaaaaaaatactttataatctaaattctaaatagtatctgctgttataatcagtatttaataatatatgtataagcattaaattaacccatatttattatatgcttgaataaacattgaattctacttggaagtttactaggggaattcctaattgtaatggtgtctctgacacatgcacactgaaatacgcacattaattttgagagtaaatttataaaaatttcaaatgattggagcttgcttcagaaggacttcatgtctccagctcctatggcactacataatcctgcatttaaacagaagctttgaaataaaccatgtgaacacattgattataaaggtgaggaaaaagaacttgagttagaactcaaattagaacttcgttctattgtgttattctgtgcgaacacttggaatttttatatgtgcttaaagtttaaaacgatgaaacagtgcaaatgagttataatgtttttggtaaatgcaaatttcaggttataaattttccagaattttagtaatatctctaacattgaaatttgaccttcttgatgctagaacctataccaaactgtggtggacagaatttactgtatcctaagcaaaatatgcttagaagtaaaattaatattacctatgttttttcttatatttataattttataaatctgttgataattaaaattaatgaaatgtatttcatgatttagatggactttaaaatatgactataaagcatcatttgtttagtgaaacaaaatataagtaattggacactattttgaaatgatattttaaaataataattacttttaattatatgtgataccaaatttttaaataaaatgtctattgaacagctagtgttcaaggcattgagcaaatgcatgttgacagtgagagctacaagccacatctaaacatcaaggattaatccatcatgatgatgaaaaatagatagcaactattatcagtacatatttttaaaaaatttatgactatttaaatgggaaataatttgtttaagtttttacattgcatatttcaacaacttgtcttgataaaggaaactcaggatgtaagcctgacacccaaagagagttggagggaattcattcattaggaaaatataaggaagaaatcatgacatcagttacctctgttaataaaaaaaatcagaaaagaacaagtaagtaaagtggcattttagaatatatagtagagtttaaaactgttaaatatttgagcataagtattttgctttgagagagaagaaaaaaatactacaccaagtaagaagtgctagttgcgtctcttagagtgtaccaaaacgatattggacattggagcctcgttatttgtcacctgaagatgactcatgggaatagaattctaaagcaatggaaacaggcactttatataggagtaaatatcacaaaacacatttttaaactcattattttgaaatatatacttaaagaatttgcaaaaatactagagttcacccatcttcctctgatagtggcatttcgtataaccgtagtacatgaacaaaatcagaaaattgacattggcacaatactgttaccttaatatagaccttattcagatttcaccagcaagcacattttttaacactaaaactttaaaaggatttaaaatatatatcctgtttttaaatcttattttttgtgagtccatagtaggtgcatatatttatgggttatgtgaaatattttgatataggcatgcaatgcataataattacatcagggtaaatggggtatctatcacctcaagcatttatcctttgtattacaaacaatgtaattatactattttagttatttaaacatgtacaattaatttaattgatttaattttacatttaaatattttttgtggataaaagtatttaaactaaatttaacttaataataagtatatatttctatactcattttctgaatatgagttataagatggttggactttatctctttattctatgtcttaaaagacttaagcttccgtgtctaagttgtacttcccaatggagtcagaatcactgagactagaacccctggaagctagaatgagacagatacagtagtaactggagctgtggggaaaccttaggttatatcctccaaatcatcttaacagcaacaagtatggaacctaatttccaatggaaatatgttttatatgtggtcttgtaaaatagtcctgtttatgaacaattctatttcagtacgacaatagacatactgaatattaaaccttaaattccagcagagaatttcagaggaaaatatttttttcaatataatatgaaaaatagtgtcaatgtttgtcaaaatgtgactctttgaatattctaatatactaagcttgaaggaaaactataaatctttttgaaatgtcttttccattttttattttagcaaagtatgcaatacttaatattccagtagtctaccagtagacaaatttacacttattatgttcaccacaaagtcttttatgactaggagattcagaacttcttataaatcttataccataatgcataacttagaataatttacataagaaaaattcaactcaaagactaaacagataccaagaataacatattacatatctaaaattagaaagcacacagacacattttagagataatagcaaaagctttttagtgcacaaataaagttagtagaagaaaaacaaggtaaaatgatacatatttttaacattacagaacattactaagaatacattgcctaaaattgatttataaacagagaaaagtcttatgctcacaacccctctattttaatataaatttaaaaagagagaaattgcaatgaaattgataatcatcatataagccatgatttgcacctttggtacacatcataattgcttggggagtgattttggaatacaccagaataaaacctggtaagtggtagtttgagataaatcaaataaaacacatttttttttctataacaaacaaaaggccaagtctggaatcattggtttctgtatggtgtattttatccaggactggcttatagattatttaagagttaaaattatgattacatggtcacatatatttgactttagacacttttaaatttagctatatattttaagtagagattcttatgaatatggaaataaaataatgtacaatggtatgataatctgatttatctaaattctgagttctagacatgccagtgagctacactggtagtaggactcaaaagtgcattatgtagggaaaaacatgatgaattgatttcttaaatctttctcagctagtggtcccttagtggcttaccctggtttgtcacctctcccatgatatttatcaatacttatgaacattttagaacctttctagccataatttggaacctaaaatgtttacctatgcatgtacttcaaggataaatatgttatgattatgttatttgaaggacctggctagagtggagcctacagctgaagtaaccagagttgggagggtatgttacgatataaatttcaaaaaaaaaatagttttaaaatatggctatgtaaaaataacttctattacttgtattttatgaacgattcaacctgtataaaaaatatagttctgtggaaaaagtttgatattagagagttctgttctttaatctctgccacattttcgctaaacatcttttctttgacctcggccaaattccttaactgttgaatctcctggggtgcctgtgagaattcaaaatgcacctcaaaacagcctaatacatggcagacattcagcaaatgttccattctcctatcccctaattatcacacaagacaattacttttaatctgtacatattgaggagctttgcatgttgtggacactttgtcaatattcgttgaaggaatgaaattgtggattaaatttgctgtattataaaactgatatcttttacttaataaaagcttggcagtatgaattgatagaaaatgagtaagtctatttatttggtggtaatgaagattactgggataagtttccaaagcaagttataaaatattgttccattaaacttttaaaatgggatttgttttcctgctttttgcctcatacagaataagtatggctctgtttcaagattctggtgtgttcatgatgacctctcaagatcaattctgaatcacagggagaaaacgttgaaatgataaagacatggatactagaaatgcaagcaagttatagaccattttatttacccatttttttttttagctcaagcaatttcgtgtcttatatttatggataaagttgaaataaaatttccctttttttctgttaaatattaagagtctggggattagttatgcagcatctatttatttatttctgtcttataaaaattatcttaaagggcttggcttaatttctataccataaagaaaaaatgtgtaagataatccctcgctatcgggatcattttcttatataattaatgagctgaacgtaaaagataggtgaatctacaaatttatttattttctgtcttataaaaattgtcttaaagggcttggcttaatttctataccataaagaaaaaatgtgtaagataatccctagctagtcgggatcattttctcatataattaatgagctgaacgtaaaagataggtgaatctacaaagaaaatgccccaggtaccatccattaaagcatgttgctgctatatgtgcaagatgtccagggtatggcttccataattataaacaatttactatgtctcaattattatttcaattgttaattcccttgtctctggattgatgctttagtgcatcatttattgtggatattttggataaaatgaatctttggattttgtaaaaacaatatttcaaatttgtatgcatctttgaagtctaaatagcatgttatacaaattgaaaattgactgtaagagttgctacagattcaaattttatgtagtttattttttatatcttgatttgtgaagaaacaaaaaccttaactttgcttggtggcaagaacaaggggattagaacatgaacacacaggatattcagagcagtgcgtttgtaaggcatgccttatttgagtttcaggtgcttgctcattaagatgaaatttttgtcaggcagtgtgtattgggagtttgctacttgaaaatcaatagtctgcattctctgccttattgtttcaatagcctcttaactgatctccctgctttcgctattgagctccctgctgcctagctctttgagctcatctcctaacacttcccctctctccagccttagtaaatgcccccacccacatccatttgtgatatcttttcattttctcccaccaagaggtggagtttaagctccccctttttgaatggcatatgaccttggaaattcatatggtcggaaattcaaatttcccaccaaattcccaccaaagttcccaaaaaaggtgggaacggaacgtaaacccccaccaaatttgaatttgaaattcaaatttggtgggggtttacgttcccaccttttgaatgccatgtgaccttggtaatttgccttgacaaatacaatgtggtaagattgacatcatgccatttctaggtttagaccttaggagaccttgaatgcttccatttattctcttggaaccctgctatcaacagatgatgaaagacttaacgttttactcaccccattcgacaggtggccaatcatcagacatgagcgaggccattgtagaacaagaaatcccctaatcttggctaggtttcctcataggtctgggttagctgttgtgggtactcatgtcttactttaaaatatggttatttaatacctctgtattgttattcctctaagaagatgtaataagtcctctggaagatatgacattaatggacttcgctgaagttttctgtgactctttatgtctcttgacataaaagacaagaatctctttaatagaaacaaagtatttgtctctatatttttatggttgaaaatgtgacttaaactagctacaatgaggaaagaacatgttacttgattgagatatggtgtttcctttagaaaagagaaatgcagttcttattgatattgtcttactggcattgtgtacagtttgatagcattcagtattgagtcttttgtgtcacagttcttgaaaaagctttgattcttgttttaagattacctatatcttgagtgattttgaaagcaagtgccaagaaaagatgttctattgatgtatacatgacaggtgaaatatcacaccttttcagaaggcttctctggtgaatttaattccaaagacaaccagagtggaggtggaagtaaaagatacgatttgtcatgttattataagtgcattacaaaagtaaagaatcatagcccatgcaggaggaatgatgtagggtcttgtttattagacatttttccccagggtttacatagcttagggattatgcaaacaaaaacaaaatatatatagtccaagataaacaagccatattgaaattgatatgtatgtatggtattaaatattgttagatttttctgaaattctcattttttatatattcaacacacattactttaattgtacgtattaaaaaaatttatcaaaataatcaatgatataaaatctctccttatatgatttaaaataatctagctatgtcagattaaaggaaactattctgtacctctatatctggtcaactcaggatttaaccaatagggcccagggtatttttagtctaaataatatacatttatgtttaaatcattgatttgaatctaatggcagcttgttgaaacatcaactgagtgcttgactttcacagacaagtaacacatttttgactgtagcatttcatctgaacaatacaaggtcaatcctcatataaagtataaataaatcaggggattctattgtatacttataacacatattcatatattagaattttatgaagttaaaaagattttattttcttaaagattatttttagagcagtttcaggttcccaacaaagttgagaagaaggtacagggatttattttacaccctctacccctacatatgcatagcctctctcattatcaacatcccccaccaaagtggtgcctttgttacaatggatgagcttattgtgttgacacatcattatcacctaaagtccatagttttcactagaattcactcttggtgttatacattctatgctttgggacaaatgcatccaccattatagtatcatatgtattttccctgacctaaaaatcctctttagttctcctattcatctttccatctgcctagcccctagcaaatactgatattttcctgtctccacagttgtgccttttccagaatgtcatatagttggaatcactcagtatgtaaccttttcacattggcttctgtaacttagtgatatgcatttaagtttcctccatgactttttatgacttgatagctgatttatttttagcactcaataatattctattgtcgggatgtacccaggtttatttatgtgttcacctactgaaagacatattggttgcatctgagtttttgcaattatgaataaaggtgctataaatattcacgggcgggtttttatgtcaaaatacagttccaactcctttgggtaaattccgaggagtgtgactactgagtcatatggtaagagcatgttcagttttgtaagaaactgccaaactgtcttttagtgtggctgtactattttgcattccaaactacagtgaataaaagttcctgttgctccgtattcttgccagcattttgttgtcagtgttctgaattttggctattctaataggtgtgtagtgatatctcattgttgttgaagatttcatttttagtcacaaaaatcatatagcattggaaggaatgttagatagcatctggttaaaatcaccacttaatgtataaacttactctgcaatatttcgttttaagcaatcatctcatccagaatccttttaagaccatctatggaatgcttcttgtcatgagatgcagaaaagctgtatgctaccaaacattagaaggccccagggctcagtccttggacatctttgctttgtgcacttactgccttggagatctcttccagtatcatggctttaaataccatttttatgctggcaattcccaaattttcatcaccaacctggacctctcccctgaactccagacacatgtatcaatctgcttagttgacatctttattttttgtctaaatgggtatgtcacacttagcgaccccaaacaaattccttactttttctcccacacctgacccttcacattcttcctcagtagtaactttatcctttcagatgatcatgccataaccttcattccttttagctcttctttttcatgcactccagtctatcagcaaattctttcaactcttccttgaaaagaagagttgaatggactcaaaatttgactaattctcaccacacctgctgcatcttagcccagtgccccttgtctctcacctgttttatttcaatagtcttgttactgttttctctgctttctcccttgctccctttaactgttttattctgaatatggcagccagcgtgattccttcacttaccaattgtatgatattcttctctattcagcctctacttataatggtcttttatctctctcagaataaaatcccaagtccccacagttgctcacaaggttctcatgcataaacatctggctccccaatgcctcttagtatatccattagtgttttccccttgtttgctcgactccagggcacaaggctcctctgttacatcagacacaccccctcccacgtcagtgccttgcacttgctgttccttttgcctgggatgctttccacacagctatctcatgagtcattcccgctcccctgcctgtcacagtcagctccttcaggtcttttctcaaacacctctgcttagtgagtccttctctagccacctgattaaacttgcaacctacttcttaactcttttcaccaatgactttttatatatatttaaataatttcttattgtctgtctcccttcacttcagatgtcagctccatgaggagagagttttgtctgttttgttcactattatatcctgcatgcctacaaaaggccctgctttatatacaccatagaatactatgcagccataaaaagaacgagttcacgtcctttgcagggacttggatgaagctggaaaccatcattctcagcaaactaacacataaacagaaaaccaaacactgcatgttctcactcataaatgggagttgaacaatgagaacacatggacacagggaggggaacatcacacactgggacctgtcggggatggggggaaaggggagggagagcattaggacaaatacctaatgcatgcagggcttaaaacctagatgacaggttggtagatgcagcaagccaccatggcacatgtatacctatgtaacaaacctgcacgttctgcacatgtatcccagaacttaaagtaaaataaataaataaataaaatgaaataaaaattaagtcccctgcttagtaagtattgattgacagaatgaattattttttatacattctaaatattagggaattctgtacttgtagggttttttttttctcaactgtgtattttaaaggagagaaagcaatcaacaactcctttgtttttaatttgggttttctatatttaacagatttatcattttattttttccctcagtgaacttgtttattaaaaagaaatctgtcactagccaaaagctgtctaccttttagctactcggcaatattggtgcataatcatgggttcttgggatgcttccaactttggtttgacctttacagattagctctgaattagggaccactgctgggtgagaagtaaggtgtaggaagaagacagatattccaacacaatctggaataattagaaggacgaagacaacaaggaaaggagactattttcagtgcttcaggcctcatttttataactgctgacacaagcctgctattaaaatagtcacatttcctcaaatattggactttcagatgcaaacggcgcagtcaaatagttctgttaacatgacctaattttcagagctaggtgttatatgtgctttcattctgagtctgtaaacctttagacctctgattctttcagccctaagctgatagtattattgtctaaaacctagcaattttctctgtaaactttatcattttgcattttataaaatcctttatacttacctatgtagagcttggagtttactatcctagggagaaggagtacaaggcaattaaaaaaaaaaaaagccccgtattcaaagcagaatgtttcaaaaagactctacttctgaaaaggggaaaaaatcaccattgttctgttggctgaatgtgttggaagtatctcaaagaagtacaattgaattaattatattttcatctctgtgtacccattcaagtctgagaacatgcacttcactgtagttttacctccttctggattacacgagaagctgcaagattatcaagatgtcagacattcctattgggataacatgacatctttactaaggacttctgtgggtctgatgttcttcttcctagaaaatcatatgaaagatactttaaaagtgccatgtacccacttgagcttattttttaattctgatttttaaaaatattttactacttaaagtgacatttaaaaagcatattaaacaacgatataagactctgacttcacaaattagtttttctaagaacatctaattagacaacttggattgtgtcttaccagggtgcatagatgtaaccaacctaagccagcccttttgacaatctgcagtatcaaagcaaaatggaactctcgtcttatacttacattagtacataggtggtctttcttgctcatctttatcccctttttaaaaaccatagcatagtgagtaacacatcttatatactgcgtattagacacatttctgtttatctttgtccctgtcttatgaatcttcattttgattatctgagcagtgttgctgatttgctctactggctttattcaactaatgccagtactcccttattggactaaggtcttaaaactaccgtgtgcttatgtgtactaaaggtagttactgtctgcaagtgaggaatacatttgatggaactgattaattagggtgattttctgtttttgtggtcaattgaaatcttttgttaattttagctttgctaattttagctgaattttctacagtaatttttatttatccataagtatttgatttctgcaaattggaagtaaaatcactcatgtttgtttacctagttggagctcagatttttattaaaatattgttaaaattttattaaaatatgcctataaaagcatagtgactggctgaatgcattgtgatgctcacgaaaatgccctctcacatctcctaccgcaagaaacacaactgagtactgggctcgagatgctgctttctggatccatcacagctttggtgctgaggccccactcttcttaggagctgcttctagtcagtgacagagtgcagcagcaggggtactaaaacgggcccattgctgagggatgtgggaactccactgatggcaatgtgagctcaagaatccccatgaactttacactgcactacagtgtaaagcttgttttccttcctccctctcttccccctattcttcaaagaggttagacccacatcgaggtgagatcggtctcttggcctcctctggcttcctcctgttttctttcataggtgttcctctctgaccctgcctctgataactcttgggtttgtctaatcttatctttgtgtctgcttttccaggaggagaacctggattaccacatgcaaaaaagatgcttttgtccaaataatttcatgtttgggccccttattcgtatttggccacaagttttaaaaacctgatctgtagtcctaaacttatatacccctatggttttttttttttttttggaagctgttaaataagtctgaatattctcttcatttatgttgttgaacctagcattcacttcttttcaatttgaactccgccaaccagtatggaaaagtatagtctcttctgtgtctgccagtcaaaggtagtttgtttaccccatttagcaaatcatgacaacttgatgactctttactaggtccactacaatgttgatatgtcggaaaacactttcacaggctactagatcctattatgcaattttgtaacagaggctcaggctggagttaaggactcacacttgccttggaagacgtgacaccctgctatttagaatgagtggtgctttgttttgttgtgcctgttatccaggatcaagacaatgagacatttaccatccccctgcatatcattttggcatgtatccttgtgaagggttgtaggaggcagcagttattaactccttaactgcacacatattttgcaaaaatagaaattttgcttgtggatagcctcccagagttgttatggtgactcatcaacaatcatttctaacacctggatatcaatacaaattatttgggaactttggcggttaagtattacctaaatcttggtgaaaattccttccttattaaagtattatcggcatactaacagcttgctccatacatccacaattaatatttcaattttattaaaaacatctgagaatgctgattttataatgtcaactttaaatctggagaatctctgagcatgaaatggtacagtagttaccatcgaaggagcagctgaaggtcagcctctgaggtgcattaattcttccaacattaactcttgtaaaaatgtcactttattgttattaagtagaggttcttaaaaggcccattaactctggtggctacaaagtggcacatcaattataaatttgttttatgtaaacggaacccccaaatgacaccatcaacatattgctttgtacttaggatcaaaataatcaaagccactatttgaaaatgtatttgcttgatttctcagacagaatctggggatagctgagcaatcatatctcatgcattgaagacaaattgcctcagtgaaatttctattatagtttaagaaaattatcttcctgaatttgacacactgaggtggctgggaatgtagttatccagcaacacctgcttaaaatgccaataggaggtatgtggtaactttgttccactcagttgctacacatgacctttggaattgccacagctaccttacagcagagaacagggacgcacacagggattttcagagaagcactaaggaaaatttgaaatgaagctaaattcaagaagtaaatgatacttagaccttttgcaaagaaaacccagagattttaaaatagacaatagcatgacaatttataaaaatgaagctatttaaacagtatgatgtatagtattcacaatagcttaaaatattttattcccaggagcaacctaatccataactttttttttttttgctaaatgttagatgttgatatttgcaatgcattgccttaaattggaagattataacaaatttgtgtattttatggtgtactgtctatgtattgtctcacagcagctttgattcacttccatattaaccttgataatttgcttctttcaacattcaggatgaaaactacttaatataattaagttggcaaagcctgcattttggcattttatcccactctacattttcttggtactgctttttctaccctcttaatttttacacatggaaataactcatgtgcctcattgtaagtcagtgtgttatttgccaagagatattctgcatgaggtctctaataagatattgaaagaatgaaaggcattttcttattggacttgcagtcatcagaatccacagaaggggtaaattacggccaaagctttacagggtaatggttaagcatgcagaattggtgcctgaatgctcgccttcagatatttgctgtatgatttggggcaagttccttaatctctttgtgctttcctttttttttttacttctaaaaagtgatgtataaatagcatttagcacaatccatctagtacactgagaactctttattattatgggcttctcaatatcctgatatagatagacataaatgcaaaccaatcacagaacagtgcttggcacataggaagtgctcaataaataacagctaccattaaaaatagaggcatgggattgatctggattttctaaatccttgaagttctaatagttttgtacagcatggggtggaaatgagcagagcagtttacaaaagagaaaacaaaattatgaatgcagactgtctacagcaacttcaatgcaattgcataaaataaattataaatataaatgcctgcagtttccacggggaaagctcaggttagtgaagggggcctaaaatgtaggtatcattggtgtcgaaataaatatacctttgaaaacgaccttttccaaccccattgaagttatctacctctcttatgaattaagtgtagaaacattgtgaggagcagggccaaggttaataagcaaagatttcggaccaagtttttatacctttttatcctgtttccccattgcaatcccctcagtgcatgtgtgtgcgcgcgcacacacacacacacacactctcactcatgcttctaacaaaaatatgttgttacagtacagattctcagtaaacatttcttaaataaaggcagccataatgtatgtttgttagcctatattagtgtgaggaaataaagtagggctactttataaccaaaatgaggaaaataaacagtaaaagaaaaataacgccaaaacaaatatgatttatttatttatccaggaatcacttatcaactacctacagatatatagatcattaagatagggtagctgcctttgggaagtttatagcttaaaaagaattataagatgtataaaagtttcaaagtgtggttaaggactgtcatagaaactctgtaagatgagagtgtttaattttactgactgtggttatgaggaaagttttaaagagaaggtacaatttgataatatcatcatagtgaggttttcattgagtaggcaatggaagggcacaaacagaagatatagaagtgtgaaacatggaggaacactcagagaactccaaatattttgaaataagtaaatcattgggctttcccagaggtatcacaagagatatggtcagaccagagtcagattatataccttaccaaggaatactgattttctagattgagtagtgtgaaaccagagacataaaggcaattcaattggatgtatactttagtaagatcacactaggaatatagtgaagaggaccagaggaggaaagacaaattaagaaaacaccagcatgtcaggtgagagaaaatgagtagtagcaatagggatggggaatgaggaatgcataaaaagaggaagaataaacaggatttgatcatcaattggacttcaggatgaaggagagaaaggaatctaagatacccctaggttttttggtttagagaatatagatgtgaaatttaggaagatgtgaaatttaggaagatgtgaagtttaggaagatgtgaaatataggtttgattatgctgtatttaaggaacctgtgggatgtctaggcatagatatcagagttggagggtgggatcagggaatgtggctagaaagatatatttcagcaaataattagtaggtaaaatcactggaatgcatgtgatgacacaccagtaatgtgtggagtgggaagagaccaaacgcaaaatcctaggaatccaatttaaagagcaggaacaattggggcaggggaaggggagagaaagagaattgttaggaaagtaagacaaaactcaggataagagagctgtgttgtggaaatcaaagatagagttgtgctatggagagattaaataaaatgaggtcatcagtgaccttggcaagaccagttcctgggaacagaatgcacacaaatctgatgattgttcttgaaaagggacagacatgagtaactggagtcagcaagagtaaatggttgtattaagcaaatgaatgaagttgtctcagatcctcttatcttgtagtgttgtgcctagcatatttgacatgcacagcatcttttttgtttgtttatttgtttgtttttgagacagggtctcactctgtcacccaggttggagtgcagtggcgcgatctcagctcactgcaacttccgcctcccaagttcaagtaattctcgtgctttatcctcccaagtagctgggattacaggtgtgcaccaccatgcctggctgatttttgtatttttactagagatggggttttgccatgttggctaggctggtctcgaactcctgacctcaggtgatctactgccttagcctcccaaagtgccaagattacaggcatgagccactgtgcccagcccagtgtatcatttttaattacttccgtcctgtctgcaacattagttttggaaataagtactaataatggctagaaaagaaaaaaaagatcatataatcattccaagaaaataaattaatgaataaattaaatattacagtacaccaaagaagggggaagtaatggaataataccttttatttttcctttaaatttatttttaatttttgtgggtacatagattaatatatttatggggtacatgagatgttgaaataataccttttagtttcattaatatgttttctgaataaagacaaaaaacttatatgcacttattgatctgttgcagtcatttctagttgtttctagtttcagtttctttacagttcattataatgcatttacttctagtgcaccatagttttctagtttagagccttaacgcctacaaagttgccaatgactttgtctggagagccctttttattaagtttcattttgaaaagtttctttcacatcagcaagcagatatacaaataggaaaaatcttaattataaggtaagattggaagagatttttaaaaatcctactctacagtaaattctggaaattgcaatatagtccatatctttgtttctttgggataaattctaggggctttcaaatgtctctatgtcaaagaatatttaatacaaaatctccaagtggtcatataaattgttagcagtgaagaaactcaagttctgtttcttggtcttcataatcatggtgagattattgtttattttaaatctacctttaaaagtgaaattatgtaatacctgtgctttggagatagcagctgcatccaaagagaccttcaatgactttgagacattaggaactcctgttgaaatgaacctatgtaggcaaatctgtgtttgtctgggttagaatatgtgactgagagttctcccgataaacttccaggtagaattcaatgtttactcaaggataagtcataaaaatgagttaatttgaagcttatgcaaatgttgttaaaactcaacaggaaccacagcaaattgcttaaaacttggaacaaaggagttttttttccaagagtactattttgacacagatacaccgtgttttattgtgctctactttattgtactttgcagatattgtatttttaacaaattgaaggtttgtgtcaatcctgttgtacagtacgtctatcaatgccattttttcaacgcatttgctcactttgtgtctccgtgtcacattggtaactctcacaatatttcatactttttcattgtgattatgtctgtcatggtgatctgtgatcagtaatctttgatgttattatgaaattgttttggggcaccacaaaccatgcccacataggaacttaataaatgtgtgtgttctgaccactctatcgactagccactcccctatctttctccctcttcttgggcctccctactccccaagacacaaaaatactgaaattaagtcaattaataatcccacaatgtcttccatgtgttcaagtgaaagaaatagtaacaggtctctcactttaaatcaaaagctagaaatgattaagtttagtgaagaaagcatggtgaaagctgagataaggtgaaatctaggcctcttttgccaaacagccaagttatgaatgcaaaagaaaagtgcttagaagaaattaaaaatgctactcagtgaacacacaaatgttaagaaagcaaaacagccttattgatgaaatggagaaagcttgtgtaatctggatagaaaatcaaaccggctacaacattcccttacgccaaagcctaatccagagcaagatcctaagtctgcaattctaagaagtgaggaagctgcagaagaaaagtataaaggtagcagatgttggttcatgaggtttaaggaaaaaaagctgtctttataacataaaagtgtgaggtgaagcagcaagagctgttgtagaagctgcagcaagttgtctggatctaggtaaaattattgatgttggtgactacactaaacaatagatttttggtgtatacaaagcagccctctattggaagaatatgccgtctagaacttttcatagctagagaggagaaattagtgcctggcttcaaagcttcaaaggacaggctgcctttcttgtcaggtgctaatacagctgatgattttaagttgaagcaaatggtcatttaccattctgaaaatcctagggcctttaataattatgctaaatctattctgcttgtgctctatacatgcaagaacagagcctggatgacagcacatgtgtttatagcatgggttgctgagtattctgcatccattgttgagacctattgctcagaaaaatatatttctttcaaaatattactgcttattgacaatgtacctggtcactcaagagctgccatggagatgtacaaggagaataatgttttcatgcttactaacacaatatccattctgcagcccatggataaaggtgtgatttttcaagtattatcatttaagaaatacatttcataaggctatagctgctatagatctgctatagctgtgatagatctaagcaaagtaatttgaaaatcttctagaaagaatttaccattctagatgccattaagaacatctgtgattcatgggaggaggtcaaaatatccacattatcaggagtttggaagaagttgattccaactcttgcagatgattttgaattcttaagacttcagtggattaagtaactgtagatgtgttgaaaatagccaaagatctacagtgaggattggagcctgaagatatgactgaattgttataatatcatgataacattttaacaaataaggagtcacctcttatggatgagcaatgaaagtggtttcttaagatgaaatctactcctggtgaggacgccatgaacattgttgaaatgacaacaaaagattcagactattacatagacttagttgattaagcagtgacagagttgtagaggattgactccaaattttaaagaagttctatgggtaaaatcttatcaaacagcattgcatgctacaaataatcctttataaaaggaagagtcagtgcagcagacttcattgttgtcttattttaagaaattgccagtcacctcaaccttcagtaaccaccaccatagttagtcagcagccaccaacattgaggcaagaccctccaccagcaaaaagattaagatttgtggaaggctcagatgatcattaacatttttagcaaaaatgtacttttaaaattaagttatgtacattgttttcagacacaatgctattgcaagctttatagactacaatatagaatacacataacttttatatgcaccgaggaaccaaaaaaatttgcgcaactcgcgttattgaggcatttgttttattgcagtggtctggaactgaatctgcaatatctccaaggtatgcttgtattatttagaactgccagcacatggtgataacggaaagcaattgactttaagtgaattttattattactttaaaaaattatctgcagaagatacatttgtttgttgtctgctccctatgcctggtctttggaaaaagcctctttttaagcaattaacatcctttttcaaagttaaactttttctttgataaaatttaaatgataaatatgttaaggatcacctatttcttaaaatattgaatgatttcaaacatatatgtcatctttactaagattacttacccatgttttccaattctgctagaaaaccagtggatcattctttgaagggtagacagtgtaccttataggttagatattatttcttatgcaacttatagtacacagaaatctatttttaaacgtacagtaaaagttaaacatacatgcagttataatatgcaatgatggtctcctacaaaaaagatcttagctattgattgattgattgattgagacggagtctcactttgtctccaggctggagtgcagtggcgcaatcttggctcactgcagcctccgcctcctgggttcaagcgattcttctgcctcaagcttcccgaggagttgggactacaggtgcgtgccactacgcacagctaatttttatatttttagtagagactgggtttcaccatgttggcgaggatagtctggatctcttgacctcgtgatctgcctgcctcggcctcctaaagtgctgggattacaggagtgagccaccgcgcctgggcaagatcttagctatttaaaatacgtatttcaaaatctctccttacctagtatctatctttgtttacttaagacgttgtaatataaatttgaactaggttatggtatttatgtttttaaatcatttaatttttccattgagtaccactctatggaaaaattattattattgatatacaataatatataattgtgtaataattatataatattgatatacaataataatatttattactattattgtatatcaattatttattgatatgcaatggtggtctcttacaaaaaagatcttagccatttaaaagatatatttcaaaatctctacttagtattcatctttgtttacttaagattattgttataatataaatttgaaataagttatggcatttatgtttttaaatcatttagtttttccattgaaggtaccactcacttcatattagtaagatttctgtgtgtttcttttgaagaattattcagaagcagacttcattgttgtcttattttaagaaattgctgatactagctagatatttacataaattgctttgactaaactataattaccttgtcactgttttctagtcaattgtaatgcagaaaaaaataattcaaactattaatatcatggtgaaaagcatgggctctcataggacattatcaagctaaaattccatatgtgctactaatcatgttaattaatttctatgcctaattctcttcatctgttaaatggggctaataatactacatagctcattactttgttttgagggttaagagtaaaaacacacagaaagttcttataataatatctagcatattgtaagcactcaacatgtataagttattttaggagataatatataataattatgtatttatttcattttcttttctttttttttttttgatggagtttttgctcttgtttccaggctggagtacagtggtgcaatctgggctcactgcaacctccacctcctgggttcaagcaattctcctgcctcagactcccgagtagctgggattacaggcacacaccaccacacccggctaattttttgtatttgtagtagagacggggtttcaccatgttggccaggctggtctcgaactcctgacctcaggtgatccgcccccccgcttagcctcccaaagtgctgggattacatgcatgagccaccgcactgcgcctggcctatttccttttctttgcttatgttgcaaagtgagaaatgcctcatatttaaccaagttgtccctaggactttaccaatctaagaatttttttttctgagaaaggcattctgaaagtcaaatctagatatactttaaatcaatatcactttaaacatttacgttagccatgttttttacagtgtaaaagactatcatataaattctgttaactatgttttattgttccctgttgtaaatttttatttatttaataaatctgtttataagaatttttttctcaataatactactgaaaaaatagatttcatccaagcacagtgttaactagataagaaaccaacccaccctattttaatagcagcattaatacttttccttaagaaaacaagacagccacttatagtataagtaagctaagaatgtcaaaagggcgctcaatatgtctttcttcaacataaaaagtgatgacaatcgatcagtctgactttcacaagaggctccctaggagagaacagcatactgataatagtaagggcaggaagcctatttagttgttttatattctgtagctctctgactgtcccagtagttacaaggcagcatgtttgacacatagctaaaattcaagatgaacgcaacacacaaaaagagggcaaaacatgatgggaccaataaggagagatcatttcttattataaaggcattaacttttttcaagatgagtgacttggagttttgagctgaagggttggctagaagaacacttcggtttacaaagagaaatgcaccctgtaatgaactgcagtggactctaaaatgaaattgctggaggctacataagaaatagaaaaaacctagaagcacaatgaaaaacatcccgatttacagcatccctaaaggcagctgagggttgaccccattactttcattgagcaatttgttccatctctcctcacacataccctcactaggacttctaaaatagaaagatgcacaacatcccttagccctttccactgtctcaaaaaggtccccaaactttgtttactaaagttttagaactttatgttttactgtgtttagtatttatttaattttctattttttttttccccttgacctagatcatagaataatatacttagaggacatttttctaaatgcaagttgctagaaatgacttggcaaagattagtacaattcacagtgtcctgcagcaatagaattaacgaggagtttttttaaagagagactgatttaattttttgatgattttgaaatataaatgctaagaagaaaatttgaaggaataattttagataatttatatctaaagtgttacaagcattttatgaaacactagctatcagattagtcaacagctttggttttaccgtcaacagatattctttaaaacattcatacaatttattgtgtgcttatgtatatctttatgcaatctttatgtgaacactcataggggactattgtataatgctatcattgttagcaacatttgtgctttgtttctgaagtcttttactgtactagtaatttttttctttgcagaaactaaagttttctattagaaaaactttagttggatcctgatttataagcagatataacaaacatcatgagagtcctagagaatatcatgtaatcttcagttgttcaatctgatgattaaattgggcagagaaaagagttccagttatgtgaaaagtatttaccgtgttaatgaatctgtgccaaaacgttcatagaggctcaacttcaggccactccctgtgttaattgctggggtaagatgtgtaacgtagacacttgcctctggatgggtcaggctccagtgggaccaggtgcattgcaggaggaatgcattactttgcccaagcgcttattaggactttgaaaagaaatgctttcattatattatttgatgttttgtacatttcagtgtcctggctagctttgaagatttcagagtaaaaagccacaatttggagattgatatttaatatttagaaacaactatgcttctgtttctctctctgatactactaaaagcaataaaccaaatatttattaaataattagttcatgggaaattatgccatttttttttttttagttggagtctcactctgttgcccagtctggagtgcagtgggaatgatcttggctcacggcaacatccgcctccccggttcaagtgattctctcacacagcttcccaagtaactgggattacaggcacatgctaccacacccagctaatttttgtatttttagtagagatggggtttcaccatgttggccaggctgtctcgaactcacgacctcaggtgatccacccttcttggcctcccaaagtgctgggattgcaggtgtgagccactgcgcctggtctcaaaccttgtattattagattaaattggggacctgcaaactttttatacaaagagccagatagaaaatatgtttggctttgcaggccgcatagtatctcttgcaactactcagatctacctttgtagcatgaaagcagtaatagacaatatgtttaaaaaaaaaaaatgagtgtggttgtgttccaataaaccttgatttacagaaacagatgcttggaatgatttggcctacgggccttttttttttttttttcttgtcaatccttgaattaagtaaagaaagtgacaggtttcctgctagaaaagggtttgttatgaggattatgtgatttaatatatgtgagatacgtagagccatgtctgcatgtagtgaatgctgtaaatgtgttatttattataataactgttagagaaatgtagaaacacatctaaaccatttataaggattacatcttgaatatatatttctttaaaacctggatcagtgactactactatacctagatttcaatttatcaaccaaccaaatacactgtgaaggattttgtggatgaaaaccttcagatgattgagtgtttcgattgcatattgcatatataagggttttctctaatagtagatatgaatagattcaataatatatgcttttttcatttgccattcatatattctttaaacttctaaccatttccccaaacttggctcattaaactgatatacattggtttactgtttatactcctgccttattttttgcatattataaatataatacaggtgtttctcagcaagaaagacaattgaataccaatgttctgaaatattcttgtttctgtcaaagacatgttcatcacaactctaccacatacactatacacatatatactattttttattttaccagatttttagaaatatccaaaacctaaaatattccagttgggggacaattatgttctactgggataagagaaagacagaaaaatgtggctttagaagcctagaaaagcagtgatttagttaagcatattcaaattttagtaatgcacagtcctgactgacacttaggactttttaatgtatctttttatttgtaggtaagattaaatagaaaataccatatttaaatctgtgaattcaaaacgatattttttgagtgcctataccatgtccaggttaagtttttctactctaatggagctaacattttataaaataacatttataaagtaagataacaaatgagtttttaaaacttggatataatttttactagagaaatactctcataaaaaccagagagactaagggaaagagttatgaaaaatagagtgaataactattttagatagggtggtattgaaagactgtttagagaaggaggcatttgaacagagagagttctaaatgaagtgagagagcaagtcatgtgaagatctagtagtagagtgtttggacagtgggaactacagtgtgaaaggccctgagatgagaaaaaagctgggatatttttagaaaagaaggaggctagtgttgggcatgaaggaaagtgatctgaaataaagtcagtgatcatttagggcctcgtgggctgtttttagatcagtgtagctctctgaggcagacatgagatggctgtgggtagggcagtgctgtgaacatcattaaagttttcccaagacccttctggtccatccagtggtagtagatataccagtagggaagctattatagcatttccctgggaaatgatggttgttagactaaagtggcagcagtgacaagggtgggaagaggtgattcaggatacatgccaaggtagagctaataggaattgctgttgagttgaatgtagagtgttggaaaaagagctgagtcaaggatgttttctatttgcgtcaggtagattctggtgtcatttactaagatgggaaggtttatgttgacagggagttgttaagaatcacaagttcaggccagatgcagtggctcatgcctgtaatcccagcactttgggaggtcaaggcgggcagatcacctgaggtcagaagttcgagaccagcctgaccaatatgatgaaacctcgtctctactaaaaatacaaaaattagccgggctgtggtggcatgtgcctataatcccagctactcaggaggctgaggtgggagaatcacttgaacctgggaggcagaggtcacagtgagccgagatcatgccacggtactccagcctgggtgacagaaggagaccctgtctcaaaaaaaaaaaaaaaattaagagttcagttttaactgtgttaggtttgtgaggctttctctatattcaaatggagctgttgagtaggcaattaaacattggaatctagagttcatggaagagatctgaattgcagatatacatttgagaggactcggtatgtaaatggtatttaaaaccatgagtctgtataaatatcatcaagatagtgagtgtagacagagaagtccaaatactaaatcttgaggtatttaaattttagttgtttggcagaagagatgaaccttcacagaagaccaagacgtgcaaagcaagttacaaggaaagctaggaaagtgtcacagccctcaagccaagtgaaatatgcctcaagatgaaatgtgtgatcaattggcaaaagctgtatagaaattgagtaagatgagaactgtcaaaattgctcattggatttggcaagatgcaagagaatgttggccttgaaaagaagagtttcaacagagaaattaaaaactgcagttaatgaaaaaaataggtgaggaagtggaaacaaagagtataaacaaatatttgactgagtttgctataaaaggagcagagaaatgctcttgtagctgactaaagacacgggacttaggaaggttattttttaaatggatgacattataatacgtttgtttgctaataggaatgttccaaagaaagagggagaaatttatgatgctgcagagaaaaggaaatattcaaatagtaaattctgccataaaaaggaatgaattaatggcatttgcagcaacctggatggaactggagactattattctaagcaaagtaattcagaatggaaaaccacacattgtatgttctcactcataagtgggagctaagctgtgaggatgcaaaggcataagaatgatacagtggaccttggggactctggaggaaatggtgggaaggaggtaaaggacaaaaggctacaaattgggttcagtgtatactgctcgggtaatgagtgcatcagaatctcacaaatcaccactaaagaagttactctgtaaccaaatgccacttgttccccccaaaaactatggaaataataaataaataaataaatagcaaattatttgagtaggcatgaagaaatggaatccattgcactagtggagggcttggactcagataatgacaataatggccatcattttttatgagtcatttacatatattaactcatttaattctaaaaataaccctgtaagctgtattttattaccacctctattttacatggacagaaaaataaacacagcaggttaagctagtaattggtagaggtggtttccaaactcaagttatctcattccagagtaccactctagagagttatatgttatacagtagatgtacatattataactgggaaaaaaggcagactacacagataaagttagggaattttttacatgtcttcataacaagatgatatagtatagtttttattctatttttcactaaagttaagtgcaagattatcatctgagaataagaaggagggatgggccactgagggatggacaatatgagagttgaagaagggatgggcaatgtagggaaagagcaaaaggtatgaaatatttgtcaagtacaggagtaaaatggccatggaaaatgacctgcaaaatctgccagtgccaaggtctcttgaagatttttgtcattattttaaagtgagatgcatcatcatgtgaggcagagagctaatttctatccatctttgcttcaaggtgtcaccagtgaaatatcgatggtgggactgacaggtaatctagaggaatagagcatgcctttcgttttcatatctgtcatccttttatctggcatggaggtgtgatggctagaactttgctagtcataattgaccatggagataagtaccacactctaggggtggtaggatattgagccaggcggcagaagtttgttctctgatgacttcattgaagtgccacagcagtcctggacttttcgcctgcagacatctctaatgggagtcagaaataaatgtgtatcttgtctaagcctgtttaggagtctcttcttcttatagtcagacttaatcctaacttattccagaatttgttttcagaagcgggttgctaaagggacaaaacctaaaaatatgactttggttaaatggaggcaaacaggtggttagcagcaagactcagatgttgcagtttctctcaacataggccactgttctgatggacacatggcatatagggagaattattttaaatatactttgggttttttttcaggtgagtaaaatggagagagaaaaggagattccacaatttcctttagtaacaaatttcactgtctagcaaactttactttcagggattgctttcaggtatgtcacttaatatttgtaccacttcatctaatttccattttcttatatactaaactcaagagacacatttagttaaaatttttaataaaatcttacacttgtcagatatttcaaatattttactttactcctgtctattataggaaatccaaaactgacttatatttaccttcttaaaccttgatatgttctcacaatctttttatttttcaaagatttatatcagtttatgacagtataactacaaaaaaaagtatagtcaccaaagtaaacaatgacatactccttgtcaaatcttagggcctatttccacgctcttggcccttatttcttatcttgcctttttcccctaaactgagagccaacatcatcatgggcgtatcaagtagagacagatcaatttgtgttggaatccagttagtcatttactagttagttatgtacctttagctagtcagaatttctttctaatcctcagttttcatccacaaaatgaactgtgttaaagactgaataaactaattttgtttactcacatttagtttatactttttttttaaaaccttcctttctttggttcaatttacaccatgcaccacctacattagtacctattgatatttgcgagggttttatgtctttgccccttctccatttctataaccatttctcaagccttcaacatggtactccttgccagcaatcattctttgctacctgtgttcctacccattctctagtttcttccagaggttccttgtccctcagcaggtctgccttcttactgcctcctgcataccgcccacttgcaccattttctatatattttctcttgcatcaattttccattgcatataataatctctagttcacaaacctgtatttgtaactctattttaaagacaatatttagtcttacttcatcccagaaatcattgactaacttcaccacaattgagacatcacttacatgaagttcctctttgtatgtgtataatttatcctcttataccattaaatttcttgtattgatcgttgattttattttaggcttgtcttaattatccatttaggatgtaaaatcttccttgtcttcatgatccgctgatggtataaaacttcctttgtttaaagaaagataaaactatctctgctgttccctgtcccatgctttgcagtgctatcactatgaggagaatttattaatttatgcatgctgcatttaatatgtaaaagcctttaaatacatgaagattggtactacaatgtcctcgatctttgctttcttaaactcaaatagtcttagttactttaaaacattttgcctagtgttatttttgtgtgtgtgtttcctctaaattcaagtgtttatattcttctttagttgagatccagaatcggcctcactgccatcatataatcaaattcatgcagagtggattggggagtttaattcctagcatctcctcttacctttgcttccatttaaaaatttaattatttctaaaattcaactaaaggccctcatttattataatttatatcattgttgaattattaattggttatttatttgctatacattatagtcaagcctgtagctgaataaagtataccttgatacattggaatacttatataaactgcataggcactaaggggctaaaagaaagtaaagtgggatatgataataaatgaaaacttattggagtagaaaatgaaaaaaatttaggttatattttatttcttttaattaagatggaattcatataacataaaattgaccactttaaagtgaacgccaatggcatttagtgtagattttattttactttatttttaacagctttattgaggtataatttacataccatacaattcaccctcttaaagtttaaaatttaatagcttttcatatatttacaacattgtgcagccatcgtcacagccaattttagaatattttatttaacccccaaaaaaccccatacctattagcagtcattccttattttcctgtatccactatacctaggcaaccattaacctactttttgtctctatagatttgcctattctggacatttcatatgaatgaaatcatatatggccttttgtatctggtttcttccatttagcataatgttttcaagattcatccgtggtatagcatgtatcactactttgttcctttttattgctgaataatattccatattgtgggtataccatgttttattatccatattatgccatattatggatatacattcatcagttgatgttcatttctgttgcttccatcttttggttattatgagtagtgctgctataaacatttgtatgcaagttttacttttaatacctgttgtcagttcttctgggtatatacctagaagtgtagttgttggattatgtttaatatgtaaacatattctatgtttaacattttgaggatctgccaaacagatcctttcctgatttctaaaatggaatatttatttttttaactgtaggctttacattccttatatatctgaccactagtttattgtaccataacaggtatttcctgatttcttttgtgctttgctttcatcaccaaataacaacttccttgaacttttaaaattacatcatttatagaatagaaatatgaaaagagttttgtgattcttagacatgaacacttccataattaaagatattcttacccctatggtaacacatggaatgaaaaggaaaatttgattcctaacattctattaattttattttctttatatatctcttccatgatgctgccaaaataattgggctcaatttaaatgcccttgtctgcttgccagtgggatgcatctgagaattcaactgtgctacattttgtttgaccacctatgtgttctactaacccctctattaactaaatgcctttttgatatagtcagtgttacttaattccaagggaaatctggggaaaatattgtaatttactgtgtacagtggagataaccacagtatgtaatatccattattgtatgggaattgtactcaagttagtccaatatggagtgatggttttaaaccttttagttaggaattaagtaaacaaatatttgtgaagcacccacccactaaatcatacaagtcactgaattaaggagagaaagtgaaaatattaatttgtggcttaattattaatagcatattaaaaatgtaaaggtttattatggttttagtcggagtttatccttcattacatatacaagtatgaaaggaaagaattatagcactaagccggtaagagaaaagcagcttgattctcttcagagtgaatagaaggaacataaccgtaaaaggaatataaacaataattccgagtgggagagaaataaattatttttaaaataattcaaggacatggcttaatgcaatgagataacatagacctgctaacctcattccagttaacaaagcacatttggttatattgtatcttttacagtttcatagtttgctgttttatagtaggaacaggataagctttaactgccttgttttcctttattcttccttttttgaccctgttaaatttaggaaagcacacacttggctcataagtgcttgttcagataaaacagtgtgcttccaaatgtagcagcaacccaccttcatcagaatctcctaagagggatgtgattgcaaaaatatcatttttcttagccctacatcatggctcttagatcagaacctctaagagttctgagctgagttatgatatagggctaagggagggcccaggaatgtacattttatcagtaaccccaggtgattagggtagggtccaggaatgtacgttttatcagcatttccaggtgattctcacatatgctaaagtttgagaaccactatactgtactgtattccctgctgtagtgactatgattgagcagaatggttaaaagcatggactttggtgtcaggcttatttgaatttaagttctgattctgttacttcattgtgatcaaaacttggataagcctcttaaattctttcagcctccactgtattcagctataaagtttaagataaaaggtgattataatctctatttacctaaagaataaagacttattaacataattctgccttatcattcttactattattagagatagggtcttgctctgtcacccaggctggagtgtagtggcatgaccatggctcactgcagcctcgacctcttggactcaagcaatcctcctgcctcagcctcctgattagctgggactacaggggggaaaccaccaccatgcctggctatttaaaaacaattttttttttttgtaatgacagaatgtccctatgttgcccagaatggtctcaaacccctggggtcaagcatcctcccaccttggcttcccaaagtgctgggattacaggcatgatccactgcacccagctgctgcccaattattaatagaatcttcctttattcttaaaactatcccactttagaggataaattatgtgatctagcatagctatgtaatcatttactgtgatgattatatgacatcacttatttgatttgatacagttggcacataatacatattttttaaatgttcttataattaatgctatttttaaaaatcaggccaactctgggcccactgcctaggagttagcccttctccataaggagcagtaaaagcaaacaaacaaacaaatttgattttttttttattttaacagagtactcaggattatctactgctttaattgcttttaaaaattgatttccatggaaaagaggtcactgattattgattgttggctagttttgtcctccatgggtacaggtctttaagtcattttgtcctcattgtttttactagcttggccatgccagttggcattgtcttgtgctaaaaggcattttgtagtagagactttggggaaaagacattcaagagaaggataataaaagtctgtacagtggaactatagtattacacaaatattattgtctataagccctattacctacaaaagataaatatgacattttccttctcttattagcttcatgatgaaacaccttgctattctgccttcagtttgcttttcacttccaagtaagtatattctagccatgggagagaggtatttaggtgtttttcttgtagttagatgggaatcctagactctctactcagactgctctgagcctaagttttttttttcactttttttttttttttttttttgagatggagtctcgctcttgtcgtccaggcaggagcacagtggcacgatctcggctcactgcaacgtccgcctcccgggttcaagcgattctcgttactcagcctcccaagtagctggaattacaggcactcgcgaccatgcctagctgatatttgtatttttattagagatggggtttcaccacgttggccagactggtcttgaactccttacctcaggtgatccgacctccttggcgtcccaaagtgctgggattacaggcgcgagccaccgagcccggcctctgagcctaagtttatcagtaatctcctaagtggtgccataaggatatgagttaatgtacatagagttcgtagcagcacatctttgttctcaattattgttttctttctttcttttttttttttttttttttttttttgagacggagtctcgctctgtcgcccaggctggagtgcagtggctcaatctcggctcactgcaagttccgcctccggggttcacgccattctcctgcctcagcctcccaagtagctgggactacaggagcccgccaccacagccggctaattttttgtatttttagtagagacggggtttcactgtgttagccaggatggtctggatctcctgacctcgtgatccgcccgccttggcctcccaaagtgctgggattacaagcatgagccaccgcacctggcctattgttttctaataccattattaagaagaatattggtggtcttaaaattgagcgagcagcagattttagggtaatatgggacttatttggctcattggcttctttcagccaccttgttcagattttttgcttctccagtaaaaaaaaaaaaaaaaaaattgttcttctttgtgagatggatgggggaaaaagaagtcatatagtttaaggagaataaggaaatcccaatatctgaacatttgagggagaagaactcaataatcaagggccaagtgacatagcagatatattgtgttttgcagtgtctgactgtcaacacgtaacaataagtggttgagattttcatactcaaggccttattcattgctttttagaaagtgtttttgttccacttccaatgaaggcataattctcaatgaaatatggaaagtgttgtagtcaacatgaaaatacatatattcaaaatagcatagcattaagcctgaagtatccaccatcatttttattcacatactactggtatttaaaatatagaaaataaatagaaatatagaaatataaacttctacagctattgccttcataaattacaaccttcatggctatcatatgtcccaaatatatgtttcagatatgtgcaaatgatgataaagaaacattcaatcatcagttatctaggagacaatgatacacactaggttatcttgagttaattatttcatgccaaacttaagtgactatgtgagaaccatatgtttggtgtgtaattcacactttcaataatgtttgtatcaactgaaatatttttcaatgaaccagcatccttataatgaacatggtgttattataaggaagctggcagtacaagtggtactttgtgttttctcatttcatgctttcatttagatttaagatgttcttggtttcatttccaagttggcatgagttagcagtaaataggaatctgctggcttgtgttacatttgcttttctgatacctctaaagaaagaatgggaagaattcagaacagtaatcagttttaattgaggttatccagatagaagtctttgttctatctaaatatcaagccaaatttcttggtatataatcagaaggaaccatgttgatttctctacttattgatgggtgtatgctttgattaaggagtcacagggaaagaagatggtaatattctcatagattaatgattgtggattttcagcagttaagaattgtattcaacctagaaaacaacttctaagaatcattaatagtgcaattcatagaagtagggttgattaaaattatgaataatttataaaatgtaatatatggatagaaagagcacattggctttatttaactcatgattaggcatacatgattattccattttcttcctttagcattgacttttagattatggaaggagaatgcctctagagagttaaagaataggcacagcacaaaagtaaaaatgaatgctccaaaagtagatatatgttgtgcttctgatgactttgcattttgtaatggatttccatcaaactgccttgctgtatcagtcagaatagtctaggttacattgtagtaatgaacagccccgaatatgaatgggctaaaactgaaaaaacaaaagatgtgtttgcatttagctcttgctatatgtctatttcaggatggagttgctggctgatatggtttggatatttgtctgctccacatctcatgttcaaatgtgatctccaatattggagatggggcttggtgggatgggaggtctttggattatgggggtggatttcttatgaatagcttggtggcttggtggcatcctcatggtaatgagtaaattctcattctattattttcttgagaaactcatatttaaaacaagagaaatgtaggtatctctaaagactgtagtaacccaattttattgatgatcagaggccaaaaaagccttgtaaccttacatgttgcttaatcctgatcatgtaacagaatcgtttggcaagagtttgaaatgcgtgaattcttggctcctattttcaatgttcctaatttaggaggtttagggtgagacccaagcatctatatttattcccttaagaactggttgttaaaaagagcctggcacctctctctttcttcttctcttgccatgtaatgtctgctcccctttgccatctaccatgaatggaagctccctgaagccctggtcagaagaagatgctggcttcatgcttcttgtacagcctacagagccaggagccaaataaatctgtgttctttgtaaattaacccagcctctggtattcctttatagggccacaaaatggactaagacgggacatgggctgtgttgcatgctatcccagactcaggcctgaggaagactccaagtggaatgctcctggtcactgtggcaggaggaaggggagtgctagaaaatcttgcaatttaattaaatgctgtcgtccagaagtgatgtacagcatttctgtccacaactctttggccagaattattctcatgaccctgccaagggcaaggtggcaaagaagtaccattctttcatgtggctgggagggaaaaaagaaccagatttagaagagcattagatatctctgtcacatctgaggaacaaattagccatcagagcaaaggtccaggcatcccatctcggcaaacaaagcatgattaaccctagagctgctgattctgagctcaccctaacttgattccctccactggccccaagctggcagctgtagctttgcaaacatgataatgcttctcttgttagaactgaatttagaattggcagcaacagaaacctgcaagctgcagttcatttgtgtatccatgcttaatttaattcttattgaatgaaatgcaccctcattttattcttgctggaaaaaaaaaaaactaacaacataaaagccagtccaactattaaatcaagattttctacaagatttgtgttaattattctctctgtcctttcacaagaataaaactgattttatttatcagttttgattcatttttgatacttgaaggaatgaggagtacagaccagctatggactatgtttattttcctgagaaactcatatttaaggcaagagaaatgtaggtagctctaaagactgtagtaatccaattttattatcagaggccaaaaaggctttgtagccttacatgttgcttaatcctgaccatgtaacaaaatcacttggcaaaagtttgaaatacgtaaattcttggcctctactttcaatgtttctaatttaggaggtttagggtgaggcccaagcatctatatttatatttaaatctcaccaggtgattccgatgggcagccagaagtgagaactgtcctggaatgttatgtaaaagaaagttattatttttgaacttgttttctaaatcaaataactatccaaacctaattttccaactttaagaataaggccatctatttagcagtacagaatccatgcttacaatgtttctggttcacttcttatgtgaaaacactgaagttgttaaataattcatagattattttgcaatcctgccagtctttatgtgtttcatgttcttgtttataagtcagtgagtagggaatacatccattttgagaatgccactctgttgtagttaatagatacagatcccattatcatagttattctaatatatgattcaccaaaataatggacaaaatgatgtaactaacaattgatttgcctgctctaatacctttctttaaaacactgtaataaaacaggaaatggttttttttaaatcatatattttgagtcaggagactagagttaaaatgaatcctagagatggaggatagtaaacgccaattgtgaagccagtaattacaggaatccatgtagtaataaacttattgtttctgtcttcaaagtacctttacttcatcctgtttaaagcttctgttgcaagcatgtcattttgaaagtaaattagactaaacatcattctgatgtccatagttcaataaagtagataaaatgcatattctatgaaagactgtcaaataaatattatgcttattcatctctctgtttgctttaaaatatactttaatttatgtaaatgagcatttaatagaaataaatagtaatgaagccacataatgcagatattgtcaagcttaaacaatccagacataggtaaggagaggcactattcaaaaggattattttaagagctgggagagggactattgcagtagaaagaatgctctagctatgagatctgtattttcaaagtcagataaaaatcttttctttgcctggccctcacctgagcactgcatatgcttactttatctcaaccctaggtggtatgaattactatccatttttagctgtcaaaattgagacacagagaagccaaatatgtcactgatattttggtttatgggggtagtgagcaaagttaggaagaactaggtgtagggaaatggtattgaaagggtggcatgacggcatgatcatacagttgattagggaatgctttttcctaacgtaagtcaatggtccagaaggcctcttaaggagaggttgtatgccgactcaggcggtgtgcatgtgtcacagttcagagacctgaaggaaagagagaagctttagttaaatttggtgaagccaaactggtaggtattttatccagattagtcagaggtataaacagttcatctaatcatttatggggtaaagactgggaatttggagggtctgtgtctggccttgtctaagtaaacaagaggggcatctgtgagtcttatctaagtcatacaggaaagacagtaagcctccagaagtaaaagggtgggaagacatctttaaccatcattgtttttcaggatcagagggctctgggaaagttcatggttcatataaagcaatagggtctagctaagtctcatccaataataggtatcatttagtgattgcctggccctcagttgagcactgcacatgatcactttatctcaaccctatgtggtatgaattattatccagttttaggtgttgaaattgagacttggaaaggccaaatatgtcactgaaatttagtggttaatctagaattcaaacttgaatgtccatagtaaaaaaatcaaactcatagtcatttatactatgacatcaaactgaagtagaaggtgcaatagtttgtttttataatttataacaaagtcattaacatttttaattattaaaagctaatgaatttttatggttcttttatttttctcttgcattttcatagatgagttccattcagacagtttgacaattaaccatgaaatctaaaaatcagaaatgattagtgccttgagttatacaatgagaccccatattgcttaacagttagaatctattgaattaaaaattaagagaaatataaaatattcttcaaagctactgagttatgcttaggatactggtctttgtaaaggaagaggaatgcaaaatgagtcatgttttattcaaggatttaaagtccagtgggaaagctatgacaatacctaatatataaataattataataataaaccacattgtcaaaagagaggtataaataagaaaggaaggtaaataaagattaatttacatttggtcaggagtatttttaagaaattgaaaaatcatacataaaaactaaaaatattggtagttttattaatgtggaatagatgattgctaagttagcttaactagatttagtaattctgtgaatgcatgatatatgtcaaatatagtacagtctttcagagaaaaaagtcatctttcaaaatgtgaaaatgctttcctattattcccaagtttcagtcattttagtgagaagtattagtaggttgtggaatacatatttcaagaaaaatgcactcaacttttaatattactcttggatttaacattgaggcagagaaaaatgctctatacagtttcaaacagatatgtattttgtgttctgaaatatagagattgaatgagagacaggaatgaacaggaccctaaggctgaaatctttacaaaagcataactgtggaggaattcacctcccaagtgaacttctctgattctcttgcttttaaacattatggcaggctctgttctttttctttggaccttgctgcgagatcctgctgagaagttctctctgcagtctgctaacagacatgtacagtgaaaattaaaattattcaattcatatatgaatgagcatattatatccagaacctacagattgtatttttgtcaatgtatggttttaaactgtttgaatttaaaaagcaatggaaattaaaatgtgactaggactttaagctaaattgttttaaaggagagtaatctgtgaaattaggacatctagagttgaaccatagagtttagaattgcaagaggacttaaaggtcatggaatccaacctcccacacagtgcaggaattcccttgtaagaaattcttagtaactagtcagctaagctctgtttgaatatccttagtgttgggaatctcactacaggggcagacatgccacttttgaatagctctaattgttaagaattttctgaactcagaaataactacctagcaaaagaggagtacttaatttgcatcagtgctttgaaaatttaaaaccaaagaaatggaaaatatcaaataatttctaaattgaataccagctccaaggggcagaattagtctcaatcattgtttggtaacttttaatactgtttccctcatgactcataatttcataaatttttgctattttgtttactaatataggggaaaatatgtgtttcagtggaagagcatgcattgtcacatatagcacaggcttgtggattattagattctagtctatcattgcctttcagctattttataactataaattttgtcttatttcacaaaatttccaatgacttctctcccaatcatgggtaagctagctttgcctccatttgcaattcagttcccttactcccagaaatgtgtgctttttaattttcctttgaactggttataacatctatctggttttcttattgaatgaataaaaataatatttttaatacatgctcattttcatttttatatctgtattagtcattattttaccttttctgaaaattatcttttaatatttgtggaggtattcccaccaagatgcccaatgatttgcttactagagccagatatactttctcatcagagaagggcacctattgagcagtttaaacctaggcttctacctaggatttctgactaaataattttgttgactgtctttcttatttttattttccactctactaattttgtgttttgcttttggtttgttttcagccagtaagttatttctgattgctggcaggaaatgttgggaatttggttttatggtctgaccatttggtgaagttattgcacatcactggcaagagtagttggaaatttggcctcaacgtcttatcatttgatgagttctgtaaatgcagtaatggtttaaagagttattttctctgtcgggtgtaagacgacagagaatcttgtttggtagggttttctatttgtcttatttgtctagtttgagctcaagtcagtgaagaatttcatgcccaccagaaagtagatatctagactaatgagtttttatttctgtgttcgtgttgaaattttagaattaaagataaccattttaaagatgctcgatgagctaagagagaaaacagataattaagcaaaatcaggaaaatgaacaaaatgaaaatatcactgaagacatacaaactataaaaaaagaacaaaaattttggacttgaagaatataatagctgaattgaaaaaaatcaccggaagggtttaccagcagacttgattgactaagtggaagaaagaatcaatgaacttcaagacatgttatttaaaattatcaggtcagaggggcaaaaagtaaaaagaatgaacatatatgaagagagactacgggacttatgggacatcaggtgggccaatatgtgtattatggatgtgccaaaaggagaagagagagatggacggacagagagctcaattaagaaaaaatggctaaaacatcccaaaatggaggaaagaaatacaaatataaattcaagaaattcaatgaactctatgtaggagaaaccccaaaagatccacacagagacacactataattacattttagaaagtcaggtacaaagagagaatcttaaaaattaaaaaaatatatatatatatcttgaaataagtcatactatatctttaaaaaatcaagagaaaaatgacttatcctgtacaaggtagctttgacaagttatcagtgaatttcttagcagaaaccttgcagaccggaagggagtgggatgatatattcaacatactgaacaaaaaagaacagccaaactagaatactatatctggcaaaattgtccttccaaaatgaaagagaggccgggcatggtggctcacgcctgtaatcccagctttgggaggctgaggtgggcggatcacttgaggtcaggagtttgagaccagcctggccaacatggtgaaaccctatctctactaaaaatacaaaaattagctgggtgtggtggtgcacacctgtaatcccagctactcaggaggctgaggcaggagaattgcttgaacctgaaaggtggaggttgcggtgagccaaaatcatgccattgcactccagcgtgggtcacaagagtgaaactccagctgagcccccgccactgcaaaaaaaaggagaaattaagattttcccaggtaaataaaagctgcaggaattcatcaccagtagacctgccctacatgaaatgctaaagagtatcctgtaagttgaaatgaaaggatgctagacaacaacatgaaaccatataaaaatattaaaatttttgataaaagtgaatatatagacgaatatagaatcctgcagtattgtaatgttaatatgtaaatcacttttaattctggtatataatttaaaatacaaaaccattttaaaaacctataaatccataataatagaaacataatataaaaagatgtcatttgcaacatcagtagcatacagtgtgtgtatgggagagatgtaaaggggtagagatcttttatgtgattgaagttatcagtttaaaatagactcctataactttatttaatccccataataaccacaaataaaatacctatagaaaataatcctatgaactggttacaacatgtgccagtttcctcactgaataagaagaaataaaatcttcggcatgtattcatatcttttaataaaagcctatgcaaacctctctttttttgtataaatgaagtagtattggataaatagatatttataataaaaatactggcttttgtcaatcttgttaaagttgaatattgataatatagtgtgatctaatatagctctgtccaatagaaatttttgtgatgttgaaactttatctattgtccaatagggtaatgactagctatgtggagctataaagcatttgaaatatggccattgctactgaaaaatataattcatttaatttaacttaaatttaaatagtcacttgtgatcacatattgtacagatctatggagtgagacttgtaagtattgccagtggcaaggaagtaacaagcctaaccatgaagagtttttgctatgtttctgtagtagaaactttcaaaccaacttacattctttttgcctgcttatatatgagttaagtaaataaaaatgaaggtttttagaaaagatcctttaaaaataatgactttgtgtattttagcatataaaaatttattttaaaatcttataccaacacttttaatcatataaaataaaatgtaacagacatctttcattatttgtaactaatatgtgtatttaattcagtttaaactgatagcattccttggaaaccaaatgcttttcaaatgataattcttagaatttttacatatcttagaagtgtttcttttgttctttgtttttttgtttgtttgtttataaaataaagacatgttacacttttgtgctagtgatctaaatgatgcaagacatgtaatcttgggagaaactagatttggaattttggtgttaaactaataatatgaacatatagcattgggagatatacctaatgctagatgacgagttagtgggtgcagcgcacaagcatggcacatgtatacatatgtaactaacctgcacaatgtgcacatgtaccctaaaacttaaagtataatttaaaaaataaataaataatatgaacatataggtaattaaatgacagtcagaaattgtcatctagaagtagatgtattggtcatctcagaaaataaccatacacaaaatacagaaatacataaaaatgcctgggatcaactaaaatttttataaagttatttttgattatcctacaaatagggatttgatgaatactaaggtatagaactttggaaactttatacttgggaaggtgttgaattatggcttctgggaaattataccaaaatagcctgctgttgaagtgaagctaagtttattgcttattgtgataatgaggattattagccttgacagaatctcattctagagaaggaaggacatagactgtctgtcatcttcctctctttcacaaacagtgccaggaataatatcacagaatcccagagtatctatattcgaaaatatatttgaaattattttggcaaatctccttttataaacaagcttttgaattctgagattgattactaaactaacatgcattgtttcatctaggtttgtatgactgatcagataacataccttattattttatcattcagacttgaacttaaaggcagagaaaggacaaaaaataaaatatttatagattatttggcaaagtataagtatctcacatctgtaaaattttaataaaattctgcaaagtttttgtgtcatgcttgcctaatgtgatttatctgtcaattggtatatagattccattaaaattcatttttaaaaaggtggaattatgactgtcataaatgtaaaataaaatggttaaaaattttatttagctcaacagttaatgaggaaaccaataagatgttacaactggtaaaaagagaattttaaaaaatacaaaacacacagatacagccaattaggaactgtgaaatgaatgtacaaatagatgcaaaaaaaatgcttcgtatccacaagacagtaatcagttgcatctacaggaggcacaattcatttacatatctatggacaataatcattataattattataatcagttttctacaatttacagagatgtaaaataactcaaagacgatgaaaggcggatatgactcagaagggtgctctagagagcacatccaattaactttttgcctatttcaaggactttcgcagtgtttttcttataaccccaatgaaaatgagaaatggtttccactttaccctactctccatcacgtcatattagtgttgcctatttgactcattagtgttatttgcctgactcctgcagccattttaatataaaaatttgaaattcctactctcaagttgaacatagaagatagtcaatattctaaatttaaaaggttaaaaacttaacgtatttgtttttaattttaacatatgtttaataaaataagaaacttgaacaccgtagtatttatggtctgcataatctgttggatttacctaattcatggattttaatacacatgttgtctttaggttacccctgagggcaattgtttttggcatacctagcataaagcaggtattccctgtaagattttttcccatttcatgtaaaaaggttaaatgctggtttggtggatcctgcttcaacattatgaagatagcatttgaactacatgtctttcgggaaattatatatggatatatctacagatgtagatataatagatacaaaccagtaagaaaggaaatctaactttttagtgatttcctttttacttttaaaaaattgctattgaattttttcagttaaatagtaacaaaaataactaacaacataggctccatacaaaatttaatttgccactttataactttttcaattcctttatactgtataaaccacagattttttgtttctagcctatagtttctgcctaaaatacaggaaatgatacttacaataccaaaatgaaaccattaaaagttttggatgctggattaagtgatataccacttaaataatgatccaactttgtctaaattcttcaagaactagaatatatataattttattatattatctcctttttacattgtttttttttcctttggatctgatttttcaaaactttagtctaataatgtatcactctgtaaagtaacattccttgtaagatttttaaagtagaaaatcttttcacatgaagatatatatgtactatatacatatatgtatatatttctaaaccctgtgttctttgtgtaattgatggaggattggtctgtagagaacaaccaaagttgcaaatcatggagaaaatctctctgaagtgcaagtaagataaagaataaaataattggagcattgttgttttaaaaaaaaaagcttctcttggaaaatgtccttaagtatacgtggttagaaaaataatgaatcctagctttaaatttgtgtgatttaacttagtttacgaatgtttatgtttttcattaatggaaaaacgtttaccaatgaagaataacatgaattgatttataataattagcatgtttaatttcaaggatactgcctcaaaacactgaattaagttttaaattattatgcatttgaccacagagagtctataccaagctattatgatgtagttatgtttgttttaatacttcagtctccacataaatggcataagataacctcatattcataatactctaagtacgtgcatgaaaaaatcaaaactgttatttgaataacaaagctcatgggacaaggaaatgatgccaaactatcttttaggaaattacagagtaaaataagttatttactttaggtacagtatttaacttgtacctagtacattgatttaacattcacatctctgataaagagttacctactagtgtcagaaatcccatatatctccaaggttttactatggctcgaatgcctcctccacacattcaggtgttaccaatgtggttgtattgagaggtggagcctttaaacaatgattaggccatgaaggctcctcctgtgtgaatgagattaaggcccttattaaagaggttacactcagtgttcagcgatcttgctcttcctccttccgccatgtgagaactcagccttccttccctccagaagacagagtaagaaggccctcacctgacatcaaaatgccagcgccttgatgttggacttcctagcctccagaactgtaagaaataagtttttgttctttataagttaaaaatatataaatacataagttatttatcatgcaatatttaaggaatacctaagcacatgcgtgctcaccatctagcttaagtaataaaacattgccaaagcagcgaaatcccctcctctttgtctgttcccttccttccctgatcatctctcctgtcttccagatatacttaccattctgaatatagtgacaatcatcctatgcatttgttatttctttttttaaatatagctgtctatccccaagcaatatatagtattgttttacagtttttaactctgcataaatagtgtgataaaatatgtgttctgaaacacacttttgttttgctcattgtacttgtgaaattcatttgatatgtgtagctctggttcattctttatcagtgacataatatttcactgtttggtctacattatcaaatggtggcctactcagaaaagaatgtggttaaaaaaaacccctaagttggacaatattctgattattatgattaatttcagatttattaaactaaagtttattttgaatcaactagcaatgaaaaaataaatattcatatttaatatgaccataaatcagcttttctattgcctttgcatcaataattaaaaaataagtaaataatgcactgattcaatagtcaggtgctatttatcccaattctacctaatttagaggtaatatattaggtaggaaacctaagagtatcagtactgattagtgatttgaggcagaaaacttgcaaattaggctgggaattgctagtaaggttctggattcaatcatgatgaagtgacttggttttatgtgcctaaggaccctgtctaatgagttgtatcgtcttaataggccacgtactggtaaaaaaaaaaaaacaaaaacataaaagcaagcaaatgttaatgatatctcaaaagagctcattaattaggcagtcggcacctcaacacagaaaaaatttctggccatgtggccctcaccccactttagccttagcaggtagaaaaactaaatgcttgaggagtatttgttactaattacctctgattggtatgccatgtctggtctcgttttgatatagagggcaaaaaacatgaaagccaatgaacattaaattgccaaagtgagtgtaacacagcaagaacatttaccatttccaccatgtttcatcataaatgggagaaataatactggagttgtggaggcaggggttttggagatatcacagatttgagtcatggacagctatgtagtgctatccattatcttaaaaaaaaaagtccttttaaaacagtattagtcatgtctacaggatattttctcagttttgcataaaatgcttcctgacattttcatgctaatataacattaaatatttctgttgtataacaatctcactagaacttggttttccttttttttaagacgtgaattttaagtggtggtcattatgatatcattgaaaggaaaccagaactaacaataattaccaaatacagcccttttattacctgtttcccaaagaatctccattttatgtaccatttgacaaatgcaacctattgtgtaagtagcaaaaactctgcaggcagagtgcatttttaatactttattacattaagactcaggtttaaaaaagtaagttatttctgttagctttagtatttttcacttcatagaaaaagcttttgtctgaattgtcctattttggggttcctggatttagtaagatgatataaaatactatactattttaagatattattaatactccactactaagaatataatattaggatttaattattttttcttgcctatacatattagactatatatttgactttgcatttgcataaagagcatattattacaatccctaacatttcttagatcgtaaggcaaacctatattcaaatgagaatatatattgaagattccatatctataagcctgagataaatgtatgatttggtgagagggagaagagaatttataataatgataaaagctattaacactaaaatattttaggatttttagcacagtgtcattatctacatgaagaaattgttatacttgcaagtgaaatagttccacgtgaattcgaatggctgggctagaaattaggaagttggtactatttggaatgaagcacttatcatttttctttttctgaagacatattttttcactcatctcttctctccaacatctttcaacttattaagcaggtcgcctaaaggagaaaccatctccagaaaaattgcaataacttctttagggctttcgtatttggcttcagtttctcctaccttccgtaatagattcaccctctttgttcacctttctaaaggaggcattgtaaggaagctttcttacagcgaatttacaatatctggtgacgtctgactcctttttttttcttaggctagacactttctcactgaaagaagccttttgtcggcatctattatgctactttcccaccgttataaatcctctatattttcttaaataggacagatgatattaggtatccagttccaatgccatagcacttgaatttaaatgtagacagtgttttattctcctaatctctgtaaactctgatagttgctttaacagaacgtgccttttttgtttgctttgttcagtggttgagctttaatagtaagtgaggagggaacatagataaaagaatgtctttaaaggccatgaaatcttccctcagtttggaacaaacaccttagcttcaatgtctctgccacttagcatatttaatttctttggacaacattgtccacagtgttgaaatgaatctgacttgaaaagctcaggcatttttaggatatatattggcattaataaatagtgtgttttgacttcagagctgtgaattacccctagttccctgataaaatatttgtaattggattttttttggtcagtattaaagtgtgtttgagtttcaagagagacatgaggagtttttaatatagaacaatttattttacttaatatcttacatttatttttggaaagtgattcattgtatttaaatttctcaaatattcaaagcaccaaggaaaattatagacaatagtttctattattatttgcttatttttctattggaaaaacttttgtttttttctcactatacaaataagttttttcaattagcttaataactttgaacaacacatttatttgacactacatttaactgttgtcaaaaatgttattggatcatggttgaataattaataaaccattgggtactttctacagaaccattttagttattttataataaagtccctcataggagatattagttgaggtgaaaattgttcctatcagtataagcccaagaactcttgtctgacaattaagcaacaaataattattgtgccctcatagaaaccactggtagctctttcatgaatgaatgacaatatttcactttgtagttaataatgtatgaagacagatgaaggtgtttgtgacagataatactccttcgtgaaatacagaatcactgctctgcaaatagtattcattaagggtgtggtatttgtctggattaagtagtttttggtggcatgtatgtataaccaattcaaaaatgcttaatgaaaatttatcactatgatagttataaggttgttttatagaatacaaagtttgcaaatgcagacaggattcataaaggagagaaagtagaataggcatgctatcaggaactcaggcagaactctcaatgtagtctctgagtttacttggtctcttgatttaattaattaattcagtcagtcaattggtcatgtgtctatttactcaacaggtgtttattaaggaccgtgtgtctaatccagtcactggaactatgtataatacagacttgacttaaaaataatatataattcacaaaccatgctactgacccatttaaattgtataatttgatgatttctaataataaccatagagttgcataagcatcactacaaacacttttagaacattttctttactccattaacagtcaatccctatccccctttcccctgctactagcaaccactagtcttctttctgttgctatggatctgcctgttttggatatttcatatgaaatgaatcatgtaatatgtggtatttcatgactggcctacttcacttagcacactataatccaaagtacttcttcctttttttgcagaataatataccgttgtatggatgcagcacattttatttatcctttcatcagctggtagacatttaggttgtttccacctcttggttattatgaataatactgctatgaacgttcacttgcaagtttttgtgtggagatattggtggtttgtgtttaaagtattgaggaaccagatttaccaaaacagctgcatcatttttcactccagctaatagtatctgagggtgccagttcctccacatccttaccaatacttgttattggtctttttcattatggccatcctagtaagtatgaaataaaatatcattatagttttaatttattatctctctaatgactaatgatacagaacatattttcatatacctattggatattcatatatcttctgtggagatataaatctttatagcgtttggtaatttttaaattgggttttctgtgctattattgaattataagagttctttatatattctagatgcaagttttcactcgcgtccgagtgaagagaccaccaaacaggctttgtgtgagcaataaagctttttaatcacctgggtgcaggcaggccgagtcctaaaagagagtcagcgaagggagttggggtggggctgttttataagatttgggtaggtaaaggaaaattacagtcaaaggggggttgttctctggcgggcaggagtgggggtcagaaggtgctcagtgggggagctttttgagccaggatgagccaggagagggaatttcacaaggtaatgtcatcagttaaggcaaggaccggccattttcacttcttttgtggtggaatgtcctcaggtaaggcaggaacaggccatttaaattttacttcttttgtgattcttcagttacttcaggccatccggatgtatatgtgtaggtcacaggggatatgatggcttagcttgggctcagaggcctgacattcctgtcttcttatattaataagaaaaataaaacaaaacagtgttgaagtgttggggcggcgaaaattttcgtggtggtgtggagagataatgggtgatgtttctcagggctgcttcgaggtggattaggggcggcgtgggaacctagagtgggagggattaagctgaaggaagattttgtggtaaggggtgatattgtggggttgttagaagaaacatttgttgtgtagaattattggtgacggcctggatacggttttgtatgaattgaaaaactaaatggaataagagaaggagaaaaacaggtattaaaggcctaagaattgggaggacctaggacgtttaattagagaatgcctaaggaggttcagcatagccttgccagcaaagattatttactttaagagttaagagtggcggtttggggatagcaccaggaagtatcagctgtgatgtcttggagaagcagtgtaaacaagagcagggcatttatgagtagttgagactggtgaataggagtatgactagacagaagatagcagggatgacaagttttttggggtgcagtctaagttggtctggtgtctggaatgagactggggccgaataaaaaggagcgtctatacaggagcttaaatgggctgtaccttgtagcattctgaggacaggcctgaattctgagaagggcaagtggtaaaagtattgtccagtcctttttaagttggtggctgagcttggtgagttgtgtttttaaaagaccattagttcactgaatactaagagcctgagaaactgcttgggtgatttgactaataaaggccggtccattataggactgtatagaggtgggaaggccaaacccacgaattatgtctgccagaaaggaagaaatgaccgtggtggccttcttagaccctgtgggaaaggcctctaactatccagtgaaagtgtctacctagaccaagaggtattttagtttcctgactcggggcatgttgagtaaagccaatttgccagtcctgggcgggggcaaatccctgagcttgatgtgtagggaagggaggaggcctgaataatccctgagaagtagtagaatagcagatggaacactgagaagttacttccttgaggatagatttccatgatggaaaggaaatgagaggttctaagagacgggctagcggcttgtaacctacacagaagaggttatgaaatgatgacagaacagaatgggcctatgaggctggaaggagatattttccttggtctaagaaccatttgccttgtgtgggaagagattgataggtggaagtttcagcgggggagtaggtgggagtgaccgatgtgaaggagaaaaactggccatgagggacagaagttggaaggctagctgcttgtctagccaccttatcagcataagcgttgcctagagcaatgggatctgacgccttttgttgccccttgcagtgaatgactccggcttcctttggaagtaaagcggctttgagaagcgtttttttattaaagaggtattaatgatagaggacccttgtgtagtgaggaaacctcttgcatggtggtgcaggatatggaaggcatatttagagtcagtataaatattgatgtgtagtacctttgcaagagtgcgggcttgacttaaggcaatgagttcagcttgttgagaggtagtggaggagggcagagctgtagcctcaatgatagatgtggaaggtactgtggcacagcctgcctttgctggtgagtggcgattaggcctggtggaactgccatcaataaaccaagtgtgttcagggtgaggaacaggaaagaaggaaatatggggaaatggggtgaatgtcaggtgtatcagagagatacagtcatgggggtcaggtgtggtatcccgaataatgtgggaggccagattgaagtctgggccaggaacaatggtaattgtgggagactcaacaaagagtgaatatagctgaaggagccggggagcagaaagtatatgcgtcaggtgggaggaagaagatagattttaggagttatgagaactgtagagagtgagttgagcatagtttgtgatttttagggcctctaaaagtattaaagcagtggcagccgctgcacgcagacatgagggctaggctaaaacagtaaggtcaagttgtttggacagaaaggctacagggtgcggtcctggctcttgtgtaagaattctgaccgcactaaccatgcctaggaaagaaaggagttgttttgtagaagggattggggtttgggagattagccggacacgatcagcagggagagcacatgtgtttttatgagaattatgccgagataggtaacagatgaggatgaaatttgggcttgactgaagtaatgggggctgtctgtgaagctttgcggcagtacagcccaggtgatttgctgagcctgatgggtgtcagggtcagtccaagtgcaagtgaagagaggctgggatgaagggtgcaaaggaatagtaaagaaagcacgtttgagatctagaacagaataatgggttgtggagggaggtattgaggataggagagtatatgggttcggcaccacggggtgggtaggcaaaacaatttggttgataaggcgcagatcttgaactaacctgtaaggcttgtctggttttaggacaggtaaaatgggggaattgtaaggggagttataggctttaaaaggccatgctgtagcaggtgagtgataacaggctttaatcttttcaaagcgtgctgtgggatgggatattggcattgaggggggtaagggtgattaggttttaatgagatggtaaggggtgcatgatcggtctccaaggagggagtagaggcatcttatacttgtgggttaaggtggggggatacgagagggggatgcaaaggaggctttgaactggggaaaagggcagcaatgaggcgtggctgtagtccaggaacagtcagggaagcagataataagggaactgggcaggtggggataactaaaaaagagtgtttaaaagaatgttttctaagttggcaccagagttggggagttttaagaggtttagaagcctggctgtcaatacctaccacagttatggagttaagggaaacaggcccttgaaaagaaggtaatgtggagtgggtagcctctgtattgattaagaaggggacggacttaccctccactgtgggagttacccagagcgtctgtgatggtcctgtaggcttccgaggcaatcaggcaatgtcagtcttcagctgctaagccgagaagatctgggaaggagtcagtcagagagcctcgggccagagttccacgggctctgggagtggctcccaggtgagttgaacagtctgattttcagtggggtcccacacagatggcacgcggcttaggaggaatcccgggctgtgggcattacttggcctggtggccagatttccggcacttgtagcaagctcctgggggaggaggttctggaggaacccctggcagctgcggttcgggcatttggagttcttctgtgctggagatgtggctggggtttgtctcacagtggaggcaaggaattgcaactcagaaatacattgctacttggctgcctctactctattattgtacaccttgaaggtgaggttaattaagtcctgttgtggggtttgagggctggaatttaatttttggagttttatttaatgtcaggagcggattgggtaataaaatgtatattgagaataagacggccttttgaccctttagggtctagggctctaaagtgtctcagggttgctgccgaatgagccatgaactaggctgggtttttcatatttgatgaaagaacctaaacgctaactgatttgggagaggtcggataaagaaaaaggagcattagccttgactatgcctttagcttcagccacctttttaagaggaaattgctgggcaggtggtggagggctagtctcggaacaaaactgtaagctggaccgggtgtcaggaggggaggtgataaaaggattatagggttggggagtagaggctgaggaagaattgggacctggctcggcctggcgaggagcagcctggggaggaggggagaggtcagatgggtctgtagaaaaggaagattagaaagactcagcaatgcttggggttgagactgagagaacaagcgggagggaaagaaggaagatttgggacgagttgcattgggaacaaagagtagggagggaacaatgtgtgaaagaatgcctggacgtcaggcacctcagaccgtttgcccattttacgacaagaattatctagatcttgtaggatggaaaaatcaaaagtgccattttctggctatttggaaccactgtcgagtttgtattggggtcaagcggcattgtagaagaaaataaggcgtttaggttttaagtcaggtgtgagttgaagaggttttaagttcttgagaacacaggctaagggagaagagggaggaatggagggtggaaggttgcccatagtgaaggaggcaagcccagaaaaaagagagtagagacacggagagaaggggttgggggggttcttgccctccagaaaagcagagaaggggtagagacacggagagaaggggtcgggggggttcttgccccctagaaaagctgtacttgccgctaagggtgaaggaccaaggcaggcgtccctgcgtggccagagacctctgaaacgtgggtgaataatcaggcaggcgtccctgcgtgattaaacaccaagggaagactgtcttcccgagcccgtgaccagcacgggagttttgggtccacggataaaacgcgtctcctgtctctaccagaaaaggaaaggaactgaaattaagagaagggagagattgaagtgtggcgccaagattgaaaggagaaagaggttgagggatagtgagagaggttggagaagagaataaaaagaggccacttaccggacttaaaattggtgagatgttccttgggctggtgggtctgaggaccagaggtcgtaggtggatctttctcatggagcaaaaagtaggaggacaggggattgatctcccaagggagttcccccctccccgatctgagtcacggcaccaaatttcactcgcgtctgtgtgaagagaccaccaaacaggttttgtgtgagcaataaagctttttaatcacctgggtgcaggtgggccgagtctgaaaagaaagtcagggaagggagttggggtggggctgttttataagatttgggtaggtaaaggaaaattacagtcaaaggggagttgttctctggcgggcaggagtgggggtcagaaggtgctcagtgggggagctttttgagccaggatgagccaggagagggaatttcacaaggtaatgtcatcagttaaggcaaggaccggccattttcacttcttttgtggtggaatgtcattagttaaggcaggaacaggccatttacatttcacttcttttgtgattcttcagttacttcaggccatctggatgtatatgtgtaggtcacaggggatatgatggcttagcttgggctcagaggcctgacacaaatcccttatacatatgatttgaaagtattttttctcattccttgggttccctttttactatctggacagtgtcctttgaaacacaagatttttaaattttgataacctctaatatatctattttttgtcttttttgttttaagtgaataactagtaagtctgcctaacttaagatcacaaaaatttctcctgtattttcttcaaagagttttatagatttagctcttacattgaggtctgtgatttattttgaggtaatgtttgtgtgtggtgtgaggatggagtccaatttcattcttcaaacttctttttttcccccttttttttagagcaaggttttgctatgttgcccaggctgatctcaaactcctgggctcaagcagtcctaccgcctctgcctccctatgtgcctggcgaatttcattattttacatgtggatattcagtttttctagcttgatacctatttttataatctaatagaaaggactggtgctcctcaaacttaaatgttagtaagaatcacctgaggttcttgttaaaatgcagattttgttatggtagtgggacctgagagtctactttcttacaaacttcctaggtgatgctgctgattctggtactgggactttttttttgtttatttttgagactgtcgcccaggctagagtgcagtgttgtgatcatggctcactacagacttgacctcctgggctcaagagatcctaccacttcagcctccagagtagctgggactataggcatgctccaccatgcctggtgtattagtccattttcacactgctataaagaactggctgagactgggtaatttataaaggaaagaggtttaatgactcacagttcagcctgtctggggaggcctcaggaaagttacaattatggtggaaggcaaaggggaagcaggtaccttcttcccaaggtggcaggaaggagagtgaacacaggaggaactaccaaacacttacaagaccattagatctcatgagaactcactacaagagaacagcatgggggaagcagcccccatgatccaattacctctacccggtctctcctttcacatgtggggattataattcaagatgatatttggctggggacataaaacctaaccatatcaccaggctaatttttgtattttttgtagagacagggtttcaccatgttgcctgggctggttttgaactcccgggctcaaatgagctgccttccttggcctcccaaagtgctgggattgcaagcatgaaccgtgcctggccattcctgggacattttgaatagcaaggaaatagacaagtactaaacaaagaattataagtgcattctaactgtgcatctgttttattttcacctgtctgacaactggctttctttgctgcttcccgtatgtgggagactataacctctatactgcttccaagatcacatcccattaggtcaagccataaacttaggagttgcaaaatggcattgctaagcctgagtttttaattcccagcagagatgagccaattggctaccttagacctatcagctcttaggtgttcagttcttagttctatcagctgtggctaggggtctggcttgtagagggctcagtgggtcagtggcagctcagagagaagagagttgtgggctggccagaaactgaatgcttttctacagatgtacaattgaccttctgtgtcatttcacagaagtgtgggcatctttgactttaaattgaaaattgttaaaggcatggtaattagcaggagtcaggaattctccaaatgactgttactgaccaattctgggcagaggagggggaaaaagaattttccttgattaccagctaaactgtgtttcatatttagcaacatgaatgatttgtgtgacttcactaaggactccgattggaacacaggcagtcctagtgcagactattgagtgggcagtcatgggtaaggtactgagcctttgtggaagctttctcatttatagactgaggaataatagctgttctgcaaagacatttttaatcattttgtttctggaacaatgtgtaggtgctgaatctgttagttttcctctctttccccgccttcctacttccagaaaagattttctgtgatttacatataaatgatcaagtataatagggccattaaattacggataaaacaagagccctctaatggaaagagaacatagtttttctacaaaaatcaaggctaagatggttactctaactgaataaaaatttaactatgagctttctggcacacatcataaaaacagaatagatgaaactgtttttaatatataaaaatcttaaaataccagttaggagagagaaaatgtttttttctaacattaaaatcatgtttacatagaataactaataagaaaaatggaatgacataattgacaatgttttaaaagtatcaaatgataaaacctttttctagtatgctccttgaattctagcctctgcacactgtctagtttctcatttttaggtatttgttacattagcatcccacttccaggtatttttatttggaagtatttttatttggaagactgggatttttattttagaagcatttaaacaaccagctttaccttatctattgaatgtctctgttctagctccccctttctttgtcccttataaagggaaaccagtagtctgttagtgaagagtgggaaaatcactaacttactgtaaggatattaactcttatatatcacataaaacatatactaggtccattacatagtacaaagaataagttgctacagtgccaataagcatgcaaataaatttgataattaacagctggtaggatttatgcatttattcactcatcatctattgagcatctattgaatattggaattatagcgagtaacaaaacaatggaccatagattatatcagaaatcttcatggttgcatgcaaatgaaagaaaaaaatagaatgaggatttatgtgcttagggcaaacactaacatagagccatttcttaggcacacatcaactaattttatactatataattacagtgcttaggtgaaaacaaataatacaatgatggttttaataaaattaaatttaactccctcttgtttcactgttactgtttttcaattaggaagcatcatgccatttgaaatttgggtaatacatatattattttcaatatttagatagcatgtatgttaaaaatattttaacttttccattttgcttttcacttcatgttatcaccctatttggacatttaatttttcttgcttgtattgttgcctgtgctgtacaatctctttattgctgcttttcttcaatccttcctgcatattgccattagactcttttcctaaagaatagtctttgttgtgagagtctcttgcccaccatctgaaatgctgatggctgaaattcaaggctttctaagagatggcagaaactaacttttttgcctcttattttgtatcactacattcatgaaagtttgaggtataataattcacacaaattcatcacataaaactttaatttgttttcatttgcggtattctccatgagtaggatagcgatttccatcctcactcgctcaaatattactcagcctttcttgtatagctcaaaggtcacttttgtgaagctttccaagttgacttcagctttcaggaatttccttcatctaactctttaagtaatttgggttagtttatatataacccagaaataatggctatgtgactcccactctatagagtaacattttttaaatctgcatctaatgatcttaaataataaggtgtactttttgctagattataccatgacatgcacacatttctccagaaatcgtcagtaagaccttcccaaagttctatattcatgtcagccacaaaattatctctctggcttcctcccattcatgtttgttcattgcctagattaagccacttcaccttccttatcctttttttttttctttaattactacagtttggttctgttgcccaggctggagtacagtggcatgacctcagctcactgcaacctccacctccctggctcaagccatcttcctacctcagcctcccaagtagctgggaccacaggtgcatgccaccatgccttcctcctccattttatcacatcatgacactctgtcttcttgctggaagttgtcattggaacttctgctgtttcctacttcctagggaacccagaattttcataccttactctcaacccatcagttcccctgagagttcaagaaacttccaggtaatagcagttcttctctcactctaaccgatttttgttgtgagacatccttgtggagactttctggtaaataaaactttctactactgtcttttctatatcattttcaacaagtactttctacacctggtaatagtgcatgttttatctactcttcaaaactaagggaaaaaatgaggacaggaagtacttttttattactcatggcttaactcagaggtccccaaacgtcgggccacagaccagtaccagtatatggcctgttaggaactgggacacacagcagagttgtgcagtgggtgagtgagcattactgcctgagctctgcctcctatcagatcagcagtggcattagattctcataggagcaggaaccctattgtgaattgtgcatgccagggagtgagggatttaggttgtgtgcttcttatgagaatctaatgcctgatgatctgaggtgaaacagtttcatcctgaaaccctccccaccgtctgcgggaaaattggcttccatgaaactgatcccttgtgccaaaaagattgagggccactggcttaacctttagcaagttctcttctttgggtgaaatacaagtaggaaatgaagcttcagtcacatattttctttccttttttttgtttgtttgtttttttgagatggagtcttgttctgtcacccaggctggagtgtagtggcgctatctcggctcactgcaacctctgactcctgggttcaagtgattctcctgcctcatcctcccaagtagctgaggttacaggcacgtgccaccatgccctgcgaatttttgtatttttagtagagatggggttttgccatgttggccaggctggtctcgaactactactgacctcaagtaatcctcctgccttggcctcccaaagtagtaggataagcttcagtcatgtattttctttctttcttttttttttttttttgttttgatcacaggcatgagccaccatgcccggcccagtcatgtattttcgatacaagccgggtgtcattgacatctaccacatgtccacacggcatttcgttcttctgcatgtagtgttaaagaaggtgtagataaaattcctgtcattccttccttttctaagcttgcatttcttttcctcctcctaaaaagaaatgataatagcttaaccaaataaagcaatttctgattatgcatgatataatagattatgttatcaggactaggtaagacaatcaacaactaaccaaatatcttaatgttggaatttattatgcgctacctatatgcatatattctatgggcaaaatattatattcatataatgcatacatatgtgtattttaagatactttgtggtttttctaaataattgtattatatttaaattatgagaaaagttaaaatattaactaatgaataaaattacatgtgtatatatgtatctgatatatataaccatatatattatatatttatatatgtgtgtaatatataacctatagtcttccctctttctccattacaagatagacctacagttatagtttttttaacacaaacttctactgaagatgcagagtattagaatttcctttcttgctatcaaactcaaacattatcatcctcatggaaacattaataatagctgtttactgtaccattagtaggtaccaagtactactctaggagatttataaaaattaaattgtttaatcataaataaataattgtgaagtgaattttgagaacatggaagctcaaggacacactgtaagtgcaggagatggaaaaaagggtatataaaattggtctgaatatccagattaaaatttctagcattcttagttggaatggtatatataacgaaatactgtgtggaactcaaaacaactactattcatcgtaagcatatttctcacagtagcatcagccacagcgtcactgagcaaagtagagaaagtggttgtgaatctgacaggccgtagcttaacatctggcacaataaatcattattatcacattcttaaggttagaaaggagtgataatttaaatgtttacataaaagaagtcacgttttaaatttctgttttcttggtaagttatacttcttagccacagtttccttgttcataaaatgggggcatttgttagatctgtaaggatccttcaagccttacaatttctacaaatttgtgattcctttcaattaacattttatcaccaaactaaattatcttaaaggttgaaagaatatgagatttaaacccaatgagttattctattgcattagattcagaagaccaatggagaaaaaagtataaaacaaatatatgcaatagagaaatatcaaaagttttccataatatttctacatgtatgtatacattgaaataacaattttaatacttaccatttaagtaaaatcatatatcgtaacttagagaataaaagcttttctaaggaattcaataattagagactttcatggtatgttgccttatgattctcttttgatttgctttgaggtatctgttacttctttgaagtttatgtttttcttacatttagttttggatattttctcccattacatttttcttccataatctctaagataaacacatttattattaaaatgcagtagatttcactagatctttaaaactcagtaacaaagtatcattttctatgcattattattatcactactaatctgtaattttatagtattgtatatacttatattattttcaggtttttggatcacatttcctagacaataatgagaaataagggcttctatttaaatggatattcaaaaagtatcatatatttgctgtggaccttcatctcagtgaatttgtgaatgtattatttataatgaaaataaaataagtgaatgctaaaaaagtttttccttttgccaggggatttaccagaaagagaacaaaatggatcatggtatgatacttttctgtgtaaatatatagagaagaaaatctaccaaagatttaacaatgattttcctacaattggggtgggaatggaatggtgagattcagaacaggttcaactctctatgtggtatctttctgaattagaacattttgaatgaatttgtatttctttaataactactaaaatatgttgttatattaagatagtcatatttagagtatttatactaattcttgaaatcacaacaatttatttcatatgtaaagaacaattgcaaaaacctctgccttgatggagtttacggttcagtgggggagagggtgataataagaaagtaaaagatggtatgtagaaaaataaaaacacagaagggcagtaggaagtgtgtatgtgtgagatataattcttagtaagagaaagaaggcctgtaactgaaaaattaacatttgagtgaaaactgaaagaaggcaagtatattattagtccagacgttctcacactgctataaagaaatacccaagactgggtagtttataaaagtaagaggtttaattgacttacagttccacatggctgcggaggcctcaggaaactcacaatcatgatggaaggcaagagggaatccatgaccttcttcacgtggcggcaggagagagaagagtgaggagtgaaggggaaagagccatttataaaaccattatatctcatgagaactcactcattatcacaagaacaggatggaggaaaccacccccgtgatctgatcacctcccatgaggggtctccctagacatgttgggattatggggagtacagttcaagatgagatttgggtggggacatagccaaaccatatcagcaagggaagaaaccacgcagttgtctgtaataggaatttcaggatgaaggaactgctaggacaaaggctctgagtcagaagcacatttggatagtcacagtaagtgggagtgtggtaggagatcaagtcagagacgtaatgaggtaataggaaacttgggccatggtgagaaattttatattggctagatgagttaagagtgaaataagcattaagaaggaagtaagtggttgggtaattgagtaaaatatggtttgagtgcctcaaaacaaagagcaaatatgaatagagaaaatactatttccccagctagcaaagtatttttggaaaaattaatatcttctcactagacatatgtatatatccaagctatttaggtaaataatttgatttaaactgataaataaattaagatattttacaatctttcattcttttcatttttttcatttatttcttgagtatctattatgtatcagaagacaaaatcacatcatactctcaagtttacagtctaagtctacaacgtaagtctaatatatccagccaaagttagatttgcatttattttgcatgataatgttagaatggtttcaagtaacacttggaaagataacctaaaatgaaaaagtttagagagtgaaatgcatattattttttatgtgggaaacatgaatcttagttgtgaaaaatagccttgatgatactctgaggaaaagtaaccaggttttttttttaaccattaagtgtgatgttagctgtaaattttttgtgaatattctttgtcttgttggggaagtccacttttattccaaattttctgacagtttttattatgaatgagtgctggattctgccaagtctttctttacatgaattcatatgattatatgatttttctttagtctcttgttgtagcggattgcattaattgatgttttattatttttatttttattagtattttttgagacagagtctcactctgtcacccaggctggagtgcaatggcacgatcttggctcactgcaacctctgcctcccgggtttgagcgattcttgtgcttcagcctccctagcagctgagattacagacatgcaccaccacatctggctaatttttgtatttttagtagagacggggttttgccatgttgaccagggctgtctcaaactcctgacctcaagtgatgcgtacacctcaacctcccaaagtgctgggattacaggcgcaagccactgtgcccaacctaattgatgttttaaatatcgaaccagcattgcatacctggtataaatcccacttgttcatggtgtatgtaattttttatgctttgttggattagattatttaatagttcattgaagatttatgcatatatatttatgagagatagcttttatttgttgtaatgtctattagggtttggtactaagttaatactggcctcttggaaaaagataggaacaattttctttacttctgttttatgaaatatattggaagattaatatttcttccttaaatgtttggtagaatttcctggtgaaataatcaggtccttgttcttttgttcttagaaggttattagtaattaattcattgtatttaatagacatagacctattgagattatctgtttctccttgtatgagtttgtgtctttcaaggaactggtttatttaatataatttatccaactattgaccatagagttatttctactgttgctttattaccatctaatatctgtgggatcaatattttacttttgatattggtaatttttgtctctctcattttttcttggctagcatggctagtggtttgtcaaatttattgatctttccagagaaccagcttttgatgtctttttttctattttccttctttcagtttcactgttttctgctctaaattttgatgtttatattcttttttagatataaagtgttgttttttctctggtttcctagggtgaaagcttagagtttcagatcttttcttcttttgcagtacatgtacctaatactatacatttcccttaagtagtatgttcactgcatcccataagttttggtcagttgtattttcattttcatttagtaatattctagaatttctcttgagaattctccttgactcgtgatttatttggaagtatgtttaactttcaaatatttggagattttcaaactgtctttctgttattgatttttagtttaattccattgtggtctggaagcatacttcatgttatttctattcctttatatttgttaaagtgtgctttatgggccagaatgtggtctatattggtgaatgtcccatgtgagcttgagaagaatgtgtattctgctgttgttggataaggtactctataaatgtcgaatatatcaagttaattgatgatgctgttcagttcaactgtatcctaacaaattttctgcctacttgatctatcagttactgaaagaggagggttgaaatctccaactttaatagtggatttatctatttttcttttcatgtttatcagcttttgcctcgtgtattttgatactctcattaggtgcttacatatttaagatgttatgtctacttgaagaatttacccttttttgttatgtagcgtccttccttatccttgatacttttcttgatctgaggtctactttatctgacattgatatggctattccagctgtttttttaaaataatgttagcatgcgatatcattctttattcttttattttcaacctatctgtctttgatacttaaagtggtttcttgtaaacaacatcaagttcagtcttgtcttctcatttactcttacagtctgttttttaattggtgtattttgaccattcacatttcaagtaaatattgatacagatggattaatgactgtcatatttgtaactgttttctatttattgcatctgttctttggggaaaggaagttaaagtcactaggtttattattccttgcaacataaattaatggctctggggggatatatgcaggtctctctgaaagtgtctattgtgaacttctagttttctttttttcgaaagccttgaccatgcagaaacatgaaactgttcatatagcattgtttcctgacagtttatagccaatctatgtcagttccataatttttaaacttagaacatttcattaacctccttatttcctttttataaacatcttcatttttcaggcattgcatttaacttgattctgaaccttactcagatgattaactcaatcctttaagaagatattgaatttctgaagaactttctcaataatgttgatttaaaatgattaatgatagtccctttacttcccattcatgcttaaattttataaaatacaatcctttttatttagaatttaaagaattttccttaaatattgtgaggtgtagcagtaacagctttttgttttgagcaaaacttttctctggttatagtaaaaactggtttattccccttcgcaaatttgcaaactcaccaaaagccctcaatctgttcttccacaaagatgtaataaagcaatttgctgttgaattctcaaaatacaagtatggctttaaaaacaacttcttctggatatattttgtgcaacagcattttaaaattcttgtttattcttttgaccacctgtgaaatttggagtattgtattttagccaggctaatataatcaattctgccaactctatgtcaactacaaggaaatattcttacttaaaacaaataaataccactaattagctcttcatttcgtgaagtctgagaatgtgaggctcagatagtaaccattgaaaaaagacaactcagaatgttgttatttgagcataattctattggttctctgacatgaaaggaagcctttctcccccaaacttcaagggattttctttatttgatctgagaatcactgataacttttgccattctcaacccaacctgattccttgtttgttatgattttaacagtgacaacaaggaaaaacatttgatgttagtaatatgtgaaatcttaggattctgtgtcattccctttattttataggtcaatacatatttaatacatttctactgcatatatagaaaaggaaagtgagatttatatactaaagcatgaagtacagtgtcacaaaagcagaagaggaaagaatttcaagaaggctgaaactgtcatcagtgttaggttcagcactatgttttcattaaaaaaagaagaaataattttcatttgaaaagttaaaaaaaaaaaacgttttgtaaagcttttggaatgagtcttactatactacacttgtttttgtaagactgcctgaccctaggaattctaagatagatgactaatatagataatggttgctgcttaagtgtgcttatgtgtaaccctaattcatcactgtccaatggttaatagatttagagtagctgcattaaaaaaaaaaacacgtgaggtctttttttaaaacataatctgtcttgtctttgtcattttggcaatagaaaatgtagttttattttgataaaggttgaagaatttattgggagaagatatctgatggcattaaaaatgtctccctcaaagcaatttaagatatcaaagttacttattgaggctcaatctgttgacacagtcatacaccaataatttcctaaaagcagtacagaatactaatgggtgattattttttagcaaagaaaatgcaaatatattctgaattgaatgaatgttatattaaaattagatgacgaatatttgaaatgaaggagaaaaagttcattagcagaaaaatctcatgaatcattaatatttccactatagagcaagttgattttttattttagtacagtaatgcatagtatcacatcaagtcatcttttgtttatacggttaaaaggaatttttcaggaaagtatttacttcataaataaagcttttttttctggaagtaattgaggttgcatagcagtgtcttcagtacggttaatgttcaaagtgaaaagaaaatatacacaaactttgggtggagaataatacagatttcaaacacatcaataattcatttgacatgaagcaaggaggggcggtgtgtcctacatgctctgccattttctctgctagaattccacttcccccattgtatcctctcaactcccacaactcctctttaaattttagttcaaatatcacttcctcaggaaggcattctcagattctcagatattgtcagtacctactctatacttatttataccaagtacttatcacatatagaattaaagattggtcgtttaatggtgttatctgtcactaaaaagaaagttcttattgtcatggaacatgaccacattgttcacagttgtattcctatgtccagaaatggcactttgaacataatgtccactcaataaatgtttgcttggatgactaaaaaaggagattttttaaatggggctagaaggtatattgcttccaatcgtcagggactttggatttgtgtttgtgtgtttaggctactagggagccatgaagagtttttatcagtagattgacaaaaggaaagcaatactcttgtcaggttgtaatgtgtagagagctttaagtgtagcaaaactgcagggaaggacactatcagagtactgatggcagttcaccttgaagacagtatggtaacaataacatacgagatggtagcattgggaaaatattcatgatacattccaagggaagaatttatagcactttgcctttgattccatgtggaggaggagtatcctagataattttaaggttttgagccaatggataagatgaatggtaatggcattactgaagaaaaggcaattcaagaaaaagagcatgtttggggagggataacagtagcaacaaaggcaacaaattgcctcttaatgagaacatgctgtcttatatcatagtagatactacacacattctttctaatttgtgcagtaattcagtgttactcttccatttgaaccgttatggaaggtaaggctcttagaggttaagaaacttgcttaaagtcaaacagttaggatgtggcagaatttggattttattccggattttatgctggctccattatgccatttttgagaggataagatgttaaattaagatagagaaatgatagaaaaaatatgtgtatatatacacatatacaaacatccatgtatataatgtctgtatatataactatagatgtatgagtgtgtgtgtctccgtgtgtatatttgttgtgtatgagaaattgaaacacatttatgtatggatatttagcaagtggtgaggaactttgagatgaggattctgcagtgatattgatgttggaaatgggcaatttattcccatatcaggttctaacatttaaaatgcacctgaatttgtattaagaaacttgtcttgctaaattttaattctatcagattaataatagccacagagcttgtaaagggaatcattattctaaccttttgaaaaaatttttttgtagctcagtttaaaaaaatggaatcatcagcaaaagtttatggttgttttgtcatccagagtgtttccattaaaaaggttttgtgattattttattcagttatattaataataaaattcgttttaatttatatttattgtgttccatcagattcttctatttgtggtgacaggtaacttaacacccttgaaaacagctgtttacaagatgccattctgtaatgtgggtttctttctcttctaatgggaggtcctaatgagcaatgtaatgatccaggaagatgagcaaaaggacttaataattgaagattgagtgcaagaagtgttctgtagaagtttattaaaaataatcattgggtattttggagataattatttcacattagaatggagaatatgattgtaccagaaaggaacatgggcaatcattctgtctatccttgtaaattcttgatctgcacctctagaattttggttctggccagtttatgctgactacatccatttttgaattacatacataattttagattgtacttcatagtcttatgcttaacagtgtgttgcctttgaaaggtatttcagtttcaatgtaagcatttcttagctcctcaaattgatggcaagctcctcctttaaggtcagcatatgttttctggagatttttatatcctttaaactgcctaatggtgagctgaatacaaaataaaaaataatacgtaggccaactatttggaaggctgaggcagaaaaatcacttgagcccaggagttcaaggctgcaatgagctatgattgcatcattgcactccagcctgggtgacagagcaagacgctgtttctaaaaataaaataaaataaaataaacttagggaattagatacagcatctcttatggcatagaaacatgaagatatttgtttctgtcaactcagggtgaaaataatctgatgaaatggaacaatctagttgaagttcagctctggctatatgacttccgctttctcacctataaaatagtgataatcaaagcatttaccagttgtatgttatcagaaattgaattttaggtactcctgtgagcatttggaatcttgttaatgttatcatttttcctaataccatcatgtgatatataatactgagaacttggaaatactaccttgtgtttttatacccagaaaactcaagtagatacaaataattagggtaatttgaatgagataaatttcagaaattaaactagtcaaaaatttcaatatttctacattttttatgtgctaagtgaagacctaggaaactcagtgggatgacagcaaatacctagacattgtgctggatcggtacagaaagataaatgaggtatttacctcatttatggactctatacttaggactctatacttaggaaatatggactctatacttaggaaacttagggaattaacataagcacaggaaatataacacacatatcaaatgtagagtcatcaattatttgaaaaatgtaaaatgttcatcatatagccatctaccattgaataattttagatgatctcaagtctcattattgtaagtcacttcccctcctcccacaaatgaccttaaattattccaccaactctgtatcttattacttcttttgtcaaagcgaatatttggtaagtaaaattttaagtaaattgcttcagaatgtcaccatcttatttcagactttcatgtacacttcaacatttgaacctttttttttgtacttaatgggactaaaaatatctgcactacctgtacgacacattgttatttgaatactttgaaactgtaaaacactttgcaaatactgagtatcattatttaactccagctaaacaaacaaggttgatatagatgttttcaatgttgctgcctgacagcaaaacatgtgttagctcagcaagagatattctgtatatactctatgaaaatactcgcagatgaactttccattaataaaaactaatcgcttggtaaagaggatattatttgtttcttcttctatcccatttgttacaaatttaggcatatgaactacaggcatatgaaaatccaggttttacagtgaaaactgtagatcagtggcccccaacctttttggcaccagggaccagttttgtggaagacaatttttccatggacagatgatggggggcaggggcaatggtttggggttgaaagtgttccacctcagatcttcaggcattagttagattctcataaggagcatgcagcctagatcccttgcatgcacagtttacaatagggtttgtgctcctgtgagaatctaatgccactgctgatctgacgaggcagagctcaggcggtaatgcttgcttgcccaccactcacctcctgctctgcagcccagttcctaataggccatagaccagtaccagtccacagcctgggggtcggggaaccctgctctggattcttgcttcattctctgatattttaccatgttttaagaagagttagggaagattataggtctaggcaatataatgtaatggcaagtcctcaggctccaaagtcatagatttccctttgtatcttggccccaatgctaatgatgtttctttagaaaagttgcttaaaaataacgtttattgaatgcgtataacatctcaggtactgttgcacatactttacatgtatgggttatttactattcccagaaacactagaagtacattattattattgtttctatttgatagattaggtagctcaggtattaaagagttgacgcgagatttgatcccaacagtgttttccagagcctgttatttttttacaccatgcttctcaggctctgtttattatctataaatgagattaaaaggtgatctactttatcagtttttgagaattaaatgagacaataggtgatgaataaattacaattcaacagcacctgtaaatgctcttgatatattccaaacatctgttggccaacatattcattttttttaacttgggtagcagtgttaacactagcatagcttctaaatagtgaaaaagaaaaaacaaatatatctatctatctatatatgtatgtgtatatatatatatatatatgcttgttaatttgaaatagctaataaagaactaagtgaaatcagctacttacaagtagaatgaaaacattaaaactaagtacaatttaagaggatgtagtgcattttgatgggctgattgttagtgtggaagagactttatttcttccctactaacattcactgttaaattggattaagttcctaattttagtcagtcaagcatataaaacctagaataaccacagagagtaggagcaaatgtagcctacaccttggcccccagcatccctaatgagggcacataactcccagaaacactgtttccccattcttaggtcaattcttgctgggacactggctttttattctcccagcttacgtcatcattcaggaagttgtaaataacaatctatgaacatgcattcaaagggaatggttacaagctcagaatcaaccagggtcacatcttcatttgggtttaacatattcaagaactagtgtaccccaagcctaaaggtagagactacctccagcgctctagcccagaatagctgtgtattgtcaagccctaacagtttatgaatagatgctctgcatgtgttctttagagctgtgctagaattgtgtgtttgaaactttaatttgtgtaggaagcacctgcagagattgttaaggggatggtgatctggttggcctgacttggggagtgagttttctgcatatccaccagattatcagaggatgcccatgcagctggtcattggagcaaacttggaataccaagcctgtaaagcacagatgatgcattacctaggtgagcttcacacatttgtaaggaagttttaagatcgatcttgtcagatacccagagccagatgactgcattttaaatctgtgtgctgctctgttttttaaaactaacatttctattctaggaatcttttattataatttagatctggaatgacttttttctaaatggctcccaatgtaatgactgtgtcttcagattcagcaaccatgttttcattatcctctgaatcacagagtataattgtgcattacagtttggggtttgtttttcctactaagaaactccttttccttgcgtcctttctgataaatatcattaatttttccactatggaataattctacttcacttttgaaacataacctcatttgaatgtattttaactgggacttcattgcctgagggaagatggattattagtgacatgtgtcttgcttcttgatacagaaaagataatataaaagtagtgtttctactatatcttaaaaaaagcttcatataagccaattttctttaatgatattgtagcaagggaaaatattgtacaactcatttaccttcatttttacatatttttcaacctcaatgataattctggagatattcatgtgccttatcttgaaatcaaattaaatcattcttttgtgatatgacacgcaatttgtgacattttgagccaacagtatattaagatttaattttcagttcattatagacctagtgcctaaatgaaatttattgagactaagtaactctgcagtgattgtgggctgatggttcaagtacagtgattcagtgattcttagtaggggagaagataggccatgtaattgaacttatctctggatttttgaaaggttgaggcaatacctgttcttccaacccctcactggctccacatttcaaacacactatacctgagttggaaatatcagcaaatgtgtttctagatggatatgtgaaaataaataattattggcttactgtgttttttaaaattgtggtataccatacgtaacatttactgctttaaacattttaagtgtacagttctgtggcattaggtacattcacattgttatgcagccatcatcaccatccatgtatagaactgagctactattttttaagatgtattttttcccttagattcttctcttctgagtttgttaatgatgtccaattaaatgtatgcttattttatatgtatgaggttactttttaaatgggaaagttgagctccatctgcctgagggcactgtaaaaatttaactttcaaaatataattcctgttttgctgttgttgttcctcatgatttccttttttatatgaatattttctttaaacatattgacagtcaatttgacaagctgtcacttctggcaaatgccactttttccattagtaacttccttctttcaagaaacactattagtcactatatcttattatattaaacatctccttttaacactggtaacataaaaatgttttactaacagttctcacacaaaaatatcatattgaaacaaaaattagaggaccagaggcatttactcagaaagaacaaactttttcttagtaatgacagtgacccaaccaatcaaataaattgaagaagtaataaaatgaatgcatttttatctgaaacggatgccaccagtaacattttgggaattccaatttaaaaggcccaatgccccccatgcaagattagtttttcaagatacttttacagggctaggacattaaaatatttgcttctctattggagcagctctttcaacaagttggaggactgatcacatccctttgccaattgcagttcagataggctctgggaaggcaaagtacaggatgtcatgcaagtgaaaacagaagtgattaatcttatggatagatcaaggaaatttatctgaactttagaagtgagacttgatgctaaataggtgtttggtgtatgaaaactaaggatgaagcattcctggtaaatagaaaggcctgattgaaagctctgagctgggaacacagcagagggaagcctactttggaaggagggattggtctggcaaagtgctggataacacaggttgtaggtcatataaaaccttgtagggggtttgagcttcttgaagcctatgagtgcaatgagaagccactgaaaggtttttagcaggaaattaacattgtttctaatttttatttttaggaaaataacttgctactaagtggtgaatgggagacaagagtgtctgtgaggctaaaggctgttcttgctgaagccccaaaatacttatttactctttcttggtgtaaatgagatgaaagatactacaggaacatcacatgtgttcaataactgcgcgagtgatatacttccctacggggacatgaacagtacttgaacagctgttaatgtctgttgcccttaggaaatttatttcatcaagcatacagtgtttcaacccttattaacttatttcataaggcataatatatctgactgtgatctgttcacttaatgctactctgctctttgcacgagcatgggacaaccagttgctctctgtagtcgtagtttattaacgtgcaattaaagacatttatcatatctctgaaaatgtctcttctcccataaaattaacatcatctcctcaaaaagatgcttacgatatatgctggattatagttactgttaaaatgtattcagaaacaaaaatagaattgaaaactatagaggaatttttttaaagcatgggctttggaatcaaacttgtgtttgaattctagttctgccacttaccagtcatttgcacttgagtaaggtacttatcccttctgaacttcagtttttcatctggaaataggcataatgacatctactttatgaagttgttggttatgtaaagccatctatgaaaaatggttagaccagtgactgacacatacgcattccataagtgatagatacataaataatataaataaaaaatgaatgctatagctgacaaatgtgattaaaaagtctacaatgcaaattatttttataaagtataaaatccatgtgaccatataatatactaggacaagaatgcctgttagatttcagattcaagacaacatactaagtttaagtgtagttatctttgctaggttagctttatgtatttgcatgaataattgtttaaatttgtctgattgtactacggactggcaggcaataaatttcattatctagtcttaaaatgtgaagagaagacagctcaaagttcatttctcatgcctgatctttctgggggatacaatgtacaacatcagataattcttttgccttcttttcttttgtgcatccagtaacagttatatcatttttttctgaatcagccttttcacaaaaccattatgtgataagctcttgtcttggaaaacctcaacagcttcctcaacacctatattttaaatcctgcttaaatgagattaaaatacggcactctgttaagctgtaaaactggctttttgcttctcagttgagtgttggtttgaatgtgtcatttgacctatattgctgctctgaatcttcctcggttgccccaatgatgacagtttcaatgatgtgggtgtttgcagcagagttgttcctaataaggaagtaacgctattgtctttcagacatcattcagcctgaaaagtactatttttcccacctagagctataaatgtctgtaaaatcttttcttcttttggtagcatttgcagcagcagcaggaaaaaaaaatagtcctagtagatttgcagcttttgtagttttggggtgttgtggttccaggctaagattcactcacccttcttcaaaagttgtatacaaagggttgatagctaaatggtgactgaagtacttgatttattagtatctggcagtcatccaatatgtactagaatacaagactctctgtcaacaatagctgcataaagagcaaactgctctgcctgaacctaaaataaggccttctgctgtctgcccgttaattgaagacaagtgggccaggagtggctgaggaaaaacgaacaaagaataggcaattgtcatgcacatggaggcactacctgtgcctctttgagaaacagaaatcccctgacctggttcttacattgagagaagctaacccagcccagtaatacattttagctccttgcatgtataattatgaccattgaaaaataggatactacctttttattgggtcaggtaagatgcaggaggagggagagcaaagtgccctacttgagggtgggattgagattagaatgtgaagagaagagcagaaagcttccttcttacacaaataaaggttctgtggattcatctagaaaaatgagttaaaaaaaaaacgagtggaactatagtttctaaagtctgtggagttgggacaaatggtaattataaagactaaatgtgaatactcatagttctttaatttgattgtattaccacttaattcatagttttgaaggaaatagccattatattagatggcacattaattttaagatgcaacccaattttcaaaatgttaaaatggaaaagaaagttaaagggtgattgttaggacaagcatctccaaatactctgtgtggaggcattttaattccatgctcttgcaaaattaaactcaaaaatgtttcaaattactgggtgttatatgcccttctggtggaagccacattttctctttcctttctttccctgtctaccctccctcttccccttcctccccaaatctatcagtaaagaccaccttgctgtgggcagctagctgaaagagaccatctgccttaggaatagcctacactagattcaaactacaaagaagcaggttgggggaaagaggaagtgaggatttcaagtcaagaaagcatcctgcctactctggcaaagtattctgccagcagcatatttggattcacactgtgggtttaattctttccgtttaatactttttgttgaccttataaagccaaaaaataaaggaacacccatggcactgctggaaagaggtaactgatttctgatgaaccggtaggcattttagccactaaccaacgtatcaaagtgggcacaactaacacatgttaacagttttcccaaagtaagaagcttggtttggagtgaacaggccttgtacttttgagattttattttatgattttgtgaattgatgttctgtggggaaaaaacttgccttagttttaatataatggtcaatgactaagaaaaatcaaggagttgggctgggtgcggtggctctcgcctgttgagaaatttacatgtccatcagtttcttgtattgtagtttgaaatcaagaaactacctcagtttcttgtacaagtagtttgaaatcaggcggtcaagtttcattctaccctgctagaatatacaagaatccaaagcaataatgtaatttatacatttcaaaaggctaatgccaaattttatcagcaaattggtcataagtctccaactggaacaaagtgagtgattgttgggcaatgtagtcctgcaatgtgaaattcttgtatgcattccttcttaaaaggaagcaaaataagcctttcctatagaatttccacttcaagattccatcatcggcacatatcaaatactgttggcaatgctgaaagtaaaagcaaggactcacataaagtcttttgttgctgaaattaaaaatagttgtcactattttcaatatcaaaatcctatggtttttgacaggtttaaattctctgttgattcatttcagaacagggtcatctttttatacttctttgacattttaaaaaataagtagtttggctagaaattgagtgtttcaagccatcttggccctttgcaccctaaaatttcagtagcactgtcaagcgaatcagttcttaagagctggaaacacaaagaagacaaatatcaaagaattaattaaaatcttttcttgaatgacaaaattgacattatctactacttatataaggagactacattgtggattaaccctgaaatcagtacttggaaagtttattccagtgtgtttcactgaaatttaaattcatgacatttgaaaaatgtaagttataattaaacactgagagtaattcttgtggttattgtatatttgttaagtattccatggtaaatgtgacctgtaaatctgttaaattaaatacttgggagtaaatttacttttactttctgtggaaacatttggattaccccaacagtaaaagtaacagattaaaaatataatattctttattttcaacttttatttcaatatatatgccagtcaaatgccagtgaataataatcacatttgattgtcaaagctcatggaatggtacacctaagatttgtacgtttctttttctttcttttctttttttttgagaaggagtttcgctcttattgcccaggctggagtgcgatggtgcgttctcggctcactgcaacctctgcctcccgggttcaagcgattctccagcctcagcctcccaagtagctgggattacaggcaagcaccaccacacccagctactttgtagttttagtggagacggggtttctccatgttggtcaggctggtctcgaactcccaacctcaggtaatccacccacctcagcctcccaaagtgctggaattacaggtgtgagctatcgtgcccagcctgtacgtttctttatatatgaagtttgcattaagagatcatgaatattgaactctagtgaatgatatgcctgctgaagtgttttaagggtgaagagtactgatgtctgcaacttacactgaaataaaatggagtgatatttggattaaacgatgaatagatgggtgggtatgtaataaagcacatataatacaatttattattgaacctagatggcgggtatatgggtgttcactgtaaaattcttccaacttttctgtgtgtttgaaaatttttcataataagatgcgaggaaaaagcttaaaacatgcttgaattataattctataatatattaatattaaaatactggaagtactcttgcttcatcaaagttactttcaaaaatattggtttttgtcatcttcaaagcatgtaataagaattttttaaattaagtattaaaataaaacttttaatgtttgaaacttaaatctcacatggcactgttcctattatggattttgggggttagacctgtagctacccatggtatcttctttcagtggctcatatatacaagatttcaatttgtagttccctcactaaaaacaaacagcctctgatgaaatttatcttgatagggacatctgaaagtgttgatgaatgccaaggactctaatggaaaacaaacaaacaaacgataatttaaaaaatactgtttgctttaaaattctactaaaatggagttagtctacatgataacattaatcccatttgctgtgccaacatttaagaaggaatctgtggtttatcatctggtttgccaattttttgttaaatatgaggaatattttagtaataattttttaaagattacatgcaataatagcttaaactttaatacccattaatgagtatccataaagaaaacaattcagtaccacttaaaaataatttgaatatcagtcatcataatacgatgaacacatttgatagagaatatgtgaatagaagtacattgaatcagttttattctatctacagatgctgaatggcatagggaattgtgggtctcatgaaattttctcagaagtacccggaggatcttcactaccagactgataaacacaattttttggttctttgcccacacaggaaacttttctagaaaagtttcaaagaatacatgccgaaacatgaatcctggaaaagaaaagtgatcttctaaatttgaaaatgaaagatttatgtggctctcacgtgaaacatcctctggcaagggagtaggtacatgatggaaatacatggattttcactgaagaaatgaaaatataagtggcaaagtaaacttcatttatactattgaaatattcaactgaggaaagtacattacttttaaattggaagaagcaagggcacatgatttttttacaggccatgtcattctctcatttctttcatattgaaattagttggacttttctttatcataacgagtgttgccacagtttacacctgccattctgacttttcgtataccacctgttgagaggaatttttttttcattctgttatctacatcattgaaaaacttaacacaatccatgtaaagaagaaacaaaaatatacttgtaatgttcacataaatatagaaatataacttaggagtccacctaatgctagaatttttatcgcattttaagtgttatggagttttaaaatttccatgtgacttaatagctggaaggaagcattaatatttaaatattaatttcaataaagataaaacaaattaatacttttaaatgaatattttaaattccctaacgagaagacaattgcataaaattaagtatgtattttagtttgaagaactaaatcattcgtgatacatgaccgtactacctgccggattcatctttttgccaaatatttcaatagtaattcttgaagtcaattctcagcacatatcaacttttactgttgtggtgggtgagagagtggagaatcaggctttaaggtgaatttataatttactatgtgaatattgccaggagttagaatgacctttaaacattttgtgaattgcctatttcaatacttaaggattttgtatacgcaaccctgtacagtaattatcaagcatactaaagttttagaactaccaagttaaacttaagaaccaaaggggccaggtgcggtggctcacgcctgtaaagcactttgggaggctgaggcgggcggatcacaaggtcaggagtttgagaccatcctggccgacagggtgaaaccctgtctctactaaaaatacaaaatttagctgggtgtggtggtgcgtgtctgtagtcccagctactcgggaggctgaggcaggagaattgcttgaaccagggagtcggaggttgcagtgagccaagatcgtgctattgcactccagcctggcgacagagtgagactctgtctcacacacacacacgaaaagaaccaaaggacgtctgttttgcagatatttagacattctattatttgctttacaaataactaagaaatacctagtgatgaataagagttggatgggtgattctgtagctaagctgttcagtaccgtagccattagccacctgtggctacttaaatttaagttcattataattaaacaaaatagaaaatttggttcttcagtcacagccgccagatttcaagtactaacagccaaatgtgcctagcagcttcgtattgagcagcacagaaagacatttctatcattgcagaaagttctactgaagagtattgttctcaactgttcatctccctgggattttatctattttgttaaaagatcagacttctaaaaacataacaacttgttttgagaattatagaagctatttgagattcaagttatctcatagaaaaagttgattgtacattttaggtgttgtattttctgaaaatatctagtattgttaaaacaagagtacttagtaagaattattgatatggcactgtacattccttgtcattaaaaaagtggtcagcacaaggaaaaaaaaaacatatatagtttaactaaaaatcacttttcctctcctaaaattattctttaagttgtggtttacaggcttgattatagcaaaccatctcaatgcctgcatgcaaatagctaaatattattgactaatctcattttgaattcatagccacaacaattctcaaaggagattcagcctctccaagcaccaaacatcctattccatttccacttcttattctctaaactgattttcacaccttcttctctctcttcaaacctccctctcacaacagttatgtcttctttttacttcattgaggaaaagaaatatgacaccccatttccctcattttttcatctgcaaatctaccagctcatctggatccaaatctacattctcctcttcccaccttttttttagagatggaatctccctctgttgcccaggctggagttcagtgtgtgatcatagcttaattactacagccttgaaatcctaggttcaataaatcctcccacctcagcttcctaagtatctaggactacaagtgcatgccaccacgcctgggtaatttttaaatttttttgcagagacagggtctcactgtgttgcccaggctggtctcagctcttggcctcaagtgattctcctgcttcagcctcccaaagaactgggattacaggtgtgagccactgtgtccagcctaaatctacactcttggcctgcctttcagttttactggaattgacaagtttacctgttctcatatcatgtccagcctttccacttggactctggatttcatttacttttaacttattcatgcatgttcttttgaaattatctctctcctccttcaatatcaatttttttgtgtgtgcctataaatatgttctgctgttttctaactttaaacccatataaaaatacgctcttttgattctcttttctctttcggatattaccttgtttttctactctccttgctacatgcaaacacacatcaaaatctagaaggaattattcatactttttattgcaattatttacctcgtattctcttttcaaattagttcatcagggcttccctgacataggctggttttctttcctcctttccttccttttttttttttctttcttgtttttgtatcctatggtcacatgactattgcattgtcaaattgaatggccatgtctctgttcttcccatacttgatccctccacagaatttggcacagttgactacttgctccttctggaaaactgtcttcttttgtactgagccacataaaatcatcctggtttcctcccctctcagtttccttttctcatcatttctgtatccccaaatgttagtgccagttctagcttcatacttttttttggattaagtcatccaatctaatgtctttaaaatgctaactatatgcaaatcacccttaatatgtttttatatttaattctaacttatctcgtgaacatgaggcttttttcccctcaaacagcttacttgacatacccatgggagtacgtatctaatatgaatgtcaaacttaacataaacagaccttttgatttttttccatcagacctcccagcataaacaacaaacaaacctgctgagccctcactgattaactggttccattatgacccgatgactaaagtcaaatttataaatgcttttataaacttcatatctaatcatcagtgaatcttgtctcctgtacctcgcatcccccaaatctggccacttttctgtttcttcattatcactaccttatctcaacccttattacttctcacctagactgttacaattatttcctgtcatgttttttttcttttgtcaccatacaattaaatctcccttcttcctctacagatacaataatctttgaaaaggtagaccaggtaattttactccactgacttcctataaccctaaggcaaagatctgaatattttaacctggtctacaaaatccttcatgtcctaacctctgcctagctttttaccccacgtcattccctttcccacttgcatctcaggccaactcctacattagcatctttatgtagttagtagatgtttctctgcatgaaatgttcttacttcagatcatctctatgtgggcttctcccttaattgatactttctcagaaatcttaattaagtgatactttctcagaaatgcctttcctgacctaacgaaagtaggaacagtcactctcaatcacttcaacctattacagttgtcagtgtggaacttatgctctctaaaatctttcttattttacttatttactgattaattatgtatctttatctgcacaaaataatctccattttatccccactgtctggagctttgcctgttctagaatctgaactctttgtatgaattaaataaggatgaagtcaaaacaaactgtactgttttttgtttcaagtatcaggcgatatttaactatttgaagttatgggactaccaaagttactccttctggttgacactttactgagacaaacaccagtgatatgaaatttccatatagtcatgcatcacttaacaacaggcatatgttctaaatgcattcttagacaattttttgttgtggaaacatcagagtgtacttacagaaacctagatagtatagcctactacaaacctaagctatatggtagagcctgttactcctacaaacatgttactgtactgaatacttaggcaatttgaacacaaaggtaagtaattgtgtatctaaacatttcttaacatagaaaaggtacaattcaaatacaatattataaccttatgctaccactatcatattatgtggcctgttattgacagatacattgttattctgttcatgactgtattagtaccaggttgtggctgtttctaatatatcctctcccactcctctcattccttactgaagtcaccagggtagtagcaaatcactggaaccagacctataatatatctgacttggtatctgtaactgttctgagaaacatgtgttgaaaggcagccaggctgcctgatgattatttagtagctgtctttctttactgaacaacagtgaataatatctttgatctctgccactgagaaataaacagaacccatcaggaatttaatccctgggaatgattttcacatttcctggtatagacgtttgattttgaagctcatatggtttgcacaataaatatttacctatttatgtcaaaatgcatgttaaatcatttttatggttggtgtgaggaatttgtgaaacaatcccatccttttgttattactgtgtttttgtaagaggacttctcacaccttaacctcatcaatagtttttcctgtgtgttaatgcaacaaaatggaagcaaaaagatatattttgttttcatttattttattcacctgaatctatccagagggaaagcactggaagtgttttctttttaagagtgttaacttgtattcttggtaagatctcatcaaaagcttaaataacgaaggtaagagtcagtattctgtggacagcttagctctacacaagaccttctgtccatcttgctagttattttccagttaatggaaatcttatagacagaaaagctcatgttagcttctcccgcatagtattatgtcaacaatccttactctaatccttgatgcagctctttacctaaatgttatagagatggagaatcacagctgccagcaattcaaaatataacatgcagtagctattttttaaaaaaaattttatttgctctcataaaaataccatcttaaagggtttttgaaaatttacttgtgattttgtctttttttaaagtattgagaaaactattgagtctgaagtaaagtctctaaaatacatcttgtcttattgtaaagtaatatgactgatattttgtgtgaattttagaattagttttttcactttatagattcattacatagtggcacttgatttaaacattgcatcagtactgtagcccttgggcatcgtgtatagagtgtctattagctttaactcatttctaaaaaattaacttctaagaataagaaaaatattgaaaactcttgaaagtaagttagaaacgaccatgattttatttttatttttaatttttatttatttatttttttgagacggagtctcactctgttacccaggctggagttcagtggcacaatcttggctcgctgcaagctctgcctccgaggttcaagccattctcctgcctcagtctcccgagtagctgggactacaggcacctgccaccacgcccggctaattttttgtatttttggtagagacggggtttcaccgtgttagccaggatggtctcgatctactgacctcgtgatctgctcgccttggcctcccaaattgctgggattacaagcgtgagccaccgcgcccagccgattttttttttttcctgcaaaaccatctaagggaggtgtttgggttttcaaggaaataccggctataagcatcattggatgttttggtggggtgggttttttgaaaatgtgtatgcagataacagtgagtgatattgcataagtattttaactacttagattgtttaaatttggttaacataaaatcaaggaaatggcttgcattattctatcttttcttttctaaacagtgtttccttaacaattaattctaacaagtcttggaaccatgggcactttctttcctcctgtcaccatgattgatccctattttgttggaaagtgaaaattgagcagttttaactctaaaggctaacattatggaaaaaaatttcaactgaatttgctagtaaatgctttgtatgaaaatatttagaatttaagtacttctctttacagacaaaatcatttattttcagtgtattatgaacatagttcctagtagggtatgtaaatgattcacttttaaattatgaatattttcttccaaattccattgttaaaattagtaagtgtaaagtatgacttttaagcaatatttcattagctatcattaacaagtatttaaccaccttgtttcaaattagttagctaatgaggtataaattattaaatctgaaaattttatttggacaagtattgtatcattaatttaaaatgattacaatgtagttgaattgttattcagtatttaatattttattgcctataaaaataaataatagccatgcaaacttatttttcaaatggtgttatctgtgctatatttaaaataggccaggtgcggtggctcacgcctgtaatcccagcactttgggaggccgaggcgggtggatcacgaggtcaggagatcgagaccatccttgctaacgtggtgaaaccccgtctctactaaaaatacaaaaaaaaaaattagctgggcgtggtggtgggcacctgtagtcccagctactggggaggctgaggcaggagaatgtcatgaacccgggaggcagagcttgcagtgagccaagatcacaccactgcactccagtctgggtgacagagcgagactccatctcaaaaaaaaaataaaaaataaataaataaataaataaataaagttaggtttgcatatatgagcatatgcatttataactagatggaaacttccttaaatatttaacatttctccttaaattttatattttatagtacttttttatggttagattctaagttctacttacattcagtgtgtatacaaattgagataggggttgtaatggaatatataacttgaatatttctatttgcattgccatagcatcattttattttgctcttagcaaaatctttctatagaggctttttctcctttcagttgtaaagaatctcttatctttaaaaaatatgtctcattattttcttacaatgtaatagtaaaaacaaaaataccatcaggtttttctcgatccttcctattttcctggatgtgtgcttttgtgtttttattgatatggataaatacatcttcaaattcaagtactagcgtttcagagaagtaatatgcttcttttgttctggttcctcttaaatgttagtaataaagaaacaattaacctagatatagaacaactcagtgaagggaaaatgtcttcatgggtcccttgagaaagacctatttagctttttatgtttctaatttttaacattgagtatagagtatatagctgtctttacacttttttttttttacattttagcttatttgtaatgctaacaggtaaagtagaaaaaaaaaatcactaaaaaaatggggatttagtagaaaaagaaaactcagtccctaaataatatcctacacatttacattatttccttatgatattttaagtgttccctatgaatatttttattttcaaaatgccaaagttatcagtaattttaaagctaatactgccaatcttactcttccaattctactcctaatcttttcctcctaaatgcttgatccaagtacctccctttgggacaagtaccaaatgtctttctccatatgattttttgaatgaattctgagtgagttaattaattaattctaggaattaatatttctttgatttctagcaagccagagcattttcttcaaatgtgcattaaccatgtgttaattatatctttatgtatacactgtagacattgtgtatgtgtctgtagatttccagcttggatttatacattttaattttcattggtttgcttttactgtcttaggcccctcaatccgtgggtagaccttggaggagcaagctttcagatcttttccactggagttctctcccccattgcagctcagtggccatcatgatatctaccagaacattcagttttctgaaactgtgtaaacactcttgtaaaaacacagtgtagagtcactgtgggagagtgtcttcaaccaccattcctatcctgtaactgaacatagctgataatatgtcagtagttttatttttgtccatcattcaaatagagttccacagtaattgtttcctcttggaagataacttgcttagcagtggggaaaaaaatggattagacagggtaaaatgttatcggaaatgggccctgatccagaaccctagagagggttcttagacctcacacaagaaagtattcggggagagtccgtacagtaaagtgaacaccagtttattaggaaagtaaaggattgaagaatggctaccccataggcagagcagcggcatgggctgcttgactgagtatacctatagttatttcttgattatatgctaaataaagggtggattattcatgagttttctgggaaaagggcaggcaattcctggaactgagggatcctcccccttttaaaccatgtagggtaacttttggatgttgccatggcatttgtaaactgtcatggtgctgatgggagtgtattttagcatgctaatgcataataattagcatataataaacagtgaggacgaccagaagtcattttcattgccatcttcggtttggtgggtgttggccagcttctttactccatccttttctgtcagcaaggtctttgtgacctgtatcttgtacaaacctcctatctcatcctgtgactaagaatgcctgacctcatggagatgcagcccagtaggtctcagcctcattttacccagctcctagtcaaaatggagtcactctggttcgaacacctctgacaaaaatattctaagtataaatacatcaaaccacattgaaaaattcatcaccaagttactttcagtacagttcattaccccatatctaaaagcgatcttgaaatctgcttggttgttagtggagacgtttcacttccttgttattaaaaaccttttcgctaactgccttattaagatattattcatataccatacagttcatgcctttaaagtgtacaattaaattttttttagtatatttacatagttgtgcaattatcaccataatcaattttacaatattttcatcacccccaaatgaaacaatgtacccattaacagttaccactcatattgctcctaacccttccccctcagccataggcaactactaatttatttcctgtctgtatgagcttgcctattctgcacaatttatataaacagaataatacaatttgttgtttcgtgactgatttcttccactcagcacaatgtttttaagattcatccatattaaaacatttatcagtacttcattctttcttattgttgaattacattccattgaatggatataccacattttatttatctgttcataatttaattgtcatttaggttgtttctagtttttgcctgttataatgctactatgaacatcatttacaagttattgatgtgtttttctgtctttatgaatagaaatgctgtgtcatatagtaactctatatttaacttcctggggaacggtcatactttccaaagaggatgcaccattttatattctcattatctaatgtatgatggttccaattcttccatctttctcaacaatacttgttgttatctgtcttttttattatagccataactgttttcagcagttctgtggatttatttcactttcttgatagtgtcctttgaagcacaatagtttttaattttttataaagtctactttatttttttttagtttttatttttggtgttatttctaagagatcattgtctaatccaaggtcacaaatttgatcctatgttttcttgcaggttttgctatagttatagcccttacatttagttaatcgatcgatttacaattaaatttttacaaagcgtaaggcagagttccagcctccttccttggttatatatatatatggatatccagttgtctcagcaccatttgttgaaaaaactatttttttctccctttaaataacctggcacctttgttaaaaaataatggatcataaaagtaagttttatttctggactctcagttctactcgttgacttatgtgtccatctttacaccagtaccacactattttgattatcagcactgagagaactttaaatggtttatggggagagagtagctttgggcttccctgagggttatgtcttgcaaaactggaagctcagccatgctactgttacaggaattattggctcttgtatgatgtgagacttgtaatccagggtgactcccacgtctatcaaatgtggacactggtttatcttctggagggtcaaggagaataatttatgaattaacatattgactgttgaacgtattctcattgaagaggaatacctaatgctgccccgctaagatgctgttcttctgccttctgttctcagaatggatctgatgccaagtatagactatagtgatcttgtgagtctcagtgttcagcagagccaaagatgaagactaggtttgtgcctagacatagaaacggggtgtaaaagggtttaagctacttggcatttgtctgtgaggaagtgtatttcacacatattggcagagtatgtttgtaattaggcaaatataggtcactggaattgatctgctgtgaactaattgatctaccttgaacaaaccctgtaaccactgagccacagcctcttcaactgtaaaatttaaagactagtaattgatagtctctatccctcatgctgaatcgagcatcctatgacttgtctaagattgttcacactgtagtttgatactttcttacattcctgaaaatgtgagttttgaggttttttcagatgattttctctatgggaaaaaatagcatacagaacattctcatgacctcagactagataataaatgactgagcaatggaactgtaactgtgaatattgaaaattataaaaaaaaattagccagacatggtggcacgtgcctgtagttgtaactacttgggaggccgaggtgagaggattgcttgagctcaagcttttgaggctgcagtgagctacgattatgctagtgtactccagcctgggcaacaaagtgacaccctatctcaaaaagtgagcccctgagtgtactgtaatgatataataaccatttctatatacttatgtgtgtatatatatatgtatgtatgtatgcataatatgatataaatcatattatggtgatgcttttgattgaaagacaaggagatcttagagtgagtggttttaactctgattatgctgctccctgatataccacaatgggtgataacacttccatgagcttcaggttcctcctcttcacaataaaagttttgtgtcacttgagttcagattttcctttcaactctaaaattatatgattaatgacatgatattcttcatatacatccatgcttctttgactatttaggccatagtgtctctctctaatacaaattttcagataatttgccaaactgaattttcaagacattccttctcagaaacatggcctccaataaacaggttttacatattttttccttttcctgttggccctaacgctgtcaatcttagcctcatcgtctagcatagtcatttatgcaggatcctgtgtaaagttgatgaaaaattctgtcaatatgaaatatattgaagattgccagtttacctttttattcatttattgtcatgtcacttgaaagatattaacgtttatatctgtctaaaaatttactctctgaaaacaataaataacatttggccttttgtgttaccgtttctattgaataattattctgaggtcccctttcacccatgaaagcacagtaacttgtactctaaagtcctacaaagtattagatatataatatctaggcataaggtaaaatctattattatgcttgggtccttaggctgtgagagtgaccagtttttactttcctacctacttgattaaggtaactccagtgaggtagaaaataagggaactgagtcaagaacacaaagtgtggtatgtaattgccattttagatatcattagtagtcacactcccgaaacattaaaaattaatgacagagtcaggaagaggagagaaggtgtcttttgcattgccataatttttacaatgtctacatgctgtcctatagcctggaatatgagatttttaaaatcatggttactatcatcactcaagtgtcttaggctgaaaaggacattttccatatttcataaattcaagtcccagccagagtaatcaggcaagagaaacaaataaaggacatccaaataggaagagaggaagtcaaattatcctgttggagacaacatgattctatatctagaaaaccctatagttttgtccccaaagctccttcacctgataacttcagcaaagtttcaggatacaaaatcaatgtacaaaaatcattagcattcctatacaccaacagcccagctgagagccaaatcaggaatgtaatccgtgtcacagttgccacaaaaataatgaaatacctaggaatacagctaactagtgacatgaaagatctctacaatgagagctacaaaacactgctcaaagaaatcagagatgacacagacaaatgggaaaacattccatgctaagggatgggaagaatcaatattattaaaatggcaatactatccaaagcaatttacagattcaatgctattcctatcaaactaacaatgatgtttttcacagaagtacaaaaaataattttaaaattcatatggaaccaaaaaagagtccaaatagccaagacaatcctaagcaaaagtacaaagctggaggcatcatgttaactgacttcaagctatacaacagagctacagtaatcaaaacagcatggtactggtacaaaaacaggcacataaaccaatgaaacagaatagagagctcagaaataaggctatatacctaaaaccatctgatcttcaaacaaagctgacaaaaacaagcaatggtgaaaagactccccagttattcaataaacggtgctgagataactggctagccacatccagaagattgaaactggaccccctccttataccatatacaaaaatcagctcaagatgcattaatgacttaaatgtaaaacttgaagctataaaaaccttggaaaataacccaggcaataccattctggacgtaggaataggcaaatatatatttcatgacaaagatgccaaaagcaattgcgacaaaagcaaaaaattgaaaaacggtatctaattaaacttaagagcttctgcacagcaaaagaaactatcaacagagtaaacagacagcctacagaatgggagaaaacatttgcaaactatatatctgacaaagatataatatccagcatctatgaggaacttaaaaaaatttgaagcaaaaaacagtcccattaaaaagtgggcaagggcatgaacagatacttttcaaaagaagacatacatgtggccaacaagtatatgaaaaaaaggtcactatcattgatcattagagaaatgcaaatcaaaaccacaatgagataccatctcgtaccagtcagaatggctattattattaataaacagtaaaaaaaaaaaaataacagatgctggctggttgtagagaaaagagaacacttacacactgttagtaggaatataaattagtttagccattgtggaaagcagtgtgacgattcctcaaagacctaaaaacagaactaccattcactcagcaattccattactgggtatatgcccaaaggaatataaattattctaccataaagacacatgcatgcatatgttcattgcagcagtattcacaatagcaaagacatagaataaatctaactgtccatcaatgacagactggataaagaaaatctggtgcatatacaccatggaatactatgcagccataaaaagagtgatatcatgtcttttgcagaaactaggatggagatgaaggccattatccttagcaagctaacacaggaatagaaaaccaaataccgcatgttttcacttataagtgagagttaaatgatgagaactcacggacacaaagaaggtaacaacagacacaggggcctacttcagggtggagggtgggaagagaggattacaaaaaaataacgattgtttactacgtttagtacctgggccatgaaataatctgtataaaaacctcctgtgacatgagtgcacctatataataaactccacatgtacccctgtacctaaaataaaagtttttaaaaataagtcaaagatgtaatcttttctctcatgtttttatatctctgaaatcaagacatattttacaattgattgggagcaattttcttgcttgaacataaaataacattgaatctcgtcatcagagtatcttggattagacaaatttagtatgttcagaggcaactttaggtagggaatgacagacctcaaattccagtgtgtcacagacttattaaataggaatatggtatgcaaaaatttgctgattaatcagcccatcataactgaggcttgactctatgcctatgtgcatttttactttgtctttcacttcaaagcaggtgcagctgcacagtatgaattcaatacccatggtaaagagtccctttaaaaggctatatttttatatttaatatgtggatacagaaataacagaaaaagataaataagctatccaaatgcaaagaaaattacattcatagacatacctcttattaccttttcctctcaactctgcagaaaatatgaagcaggttggaatgttcattttatgtggctctcaaggtactattctcataaaggtaaaatgagaaacagtaaattattgtgaagtttagtaataagagcaaaaaagacatatatttatgagagcaaaaatattgagtagcatttggccaaaggatcttgaaactgatttgaattgatttaaccagtgtaaataaaaatgatttatcaataaaagcttatttctagaagtgtttttttcctgtttttactgttcttttcagaagcgttcctttgcttatgaacagtttagaatatgatctttttgtcaaataaaatttccagcaccttgcaatatcagagacgattttctttctagaagttttagaagacgtcattatgtgtcattctagacaaataagatgtgtttggctgaaatgttttagaagtctctaaggaaagaaataacctgttgattatattttgacttacttggggaaatggaaagtcacagccaagataatgctaagtctccaccaatcacattttattatgtggtgtgcttgcctttggccctctctctaccccttggaggaacaggtaaatattggcacaagtcagatgaaccctacccatcactttttggatatatctacatgtcataagaattatgacatgatcaatcaatgtaccagctaattttcataaatgctgtacctcatgaatggagaattgagttgagcatgagtgaaaattggattttccccactcagaaaaaaataagccactatatatattttttgtttagttctttttattttggttattcttcttttcctttatattattacttaaatttatttatgatactgcttcaagcaatatttaacgtatcaacattttgaacagttttaagtataaaaaaatttgaaattctgttctagtgtgaaaatacaccagtgagtgacatatttgaatgaacatttgtagaagtatgttgaccttaaaaagcaaaaggatttatttttccttttattcaacagatattcatatttgtaccagtcattgtgtaaagctctggggaatgtttcacattttcaaaagggtagagattagcgtttcattttgtttttgacttatctctcttgttacaagctctctgcaagatatttacttaagagttggatgaaatgggtaaataaaaagaaatttatgaggcagaagaaaatgtggaaccttcagacatccctttttggtaccacttttatgacactttcatctaatctagctccatctcaattgacctccatctaattagtcataaaagagaatcaagttctatactgagcaagcatgcctgtgcttcatcagtaacatttaagaaggggcagaaatgagtcaaacacttaaagatgctgctttaaaaattttaatgtgttcttcaaagatgcaagcttattaaaattttagttctgaagaagtaagcacagtatctagtttggctccactgatccttttagacatatgtcacacactttcttctcatgctcaagagggtgattacatcatttgcatagatgtccgttttatctctaatagattatgaattccttcagggaaatacttgttttaaggggaataccatgtttttaaaatctttattttgcagagagtaactatgccatcaccttgcatgtaataggtttttaataaatctaattaagtaaaagtaccattgacttctgttcttggtggtctcaaagataatacttgagtctgctaaatttggaggactaccatgtagaaaagaaaagaaaagaaatgcttctaaagattccgagtaaagctagaaacatagttccgtagttcctagtctctccgtagagagaatacgataactgaagagggctttatatgctgagatgaaatttagtttgttcaaatccgtaatgaattgccatcgggaagtactggactgcttgccactataagtgttcaatcagtctggacaagattttgagaggaattttctagagagatcttagtcatctaatttgcggctggcctacttgacctttttcttctttactcctgaatcttgtttataaaaaatgcaatgtaataaaatataatttatattgtatgtaatataaattatttatacctctgtgaatatatatgataaacaaatgaatatatacaatgtaatgttatattacatcatgggtcattttcttcctaaactataatcatttttacagttttaaaccaaaaaggtagtgaaaataagcgagcccatattaaatttctaggaagtatccctaaattgtttcctcagtcttttgacttatttcacatggaatcctaacatacgtggttgtctgtttttcatgtctcaataaaaaaagttgaccataatataaaggataattggaacttggccacatataggaatataagacatctaatagtaaaaaaaaaaaaaaaaaaagtttataattaaagagaatcgtaagttttataatgacttagaggcatcagatgaaagagaaaacttgttctgtgcaatcccaggggaaagaattaggaaaaatgaggtcaaagctgaaagaagtacaggtttctgtttaatataaggaagatatttttaacatttttctgaaaacggacaattttgcctcaagtagtttcatcttaacagataatatattttcaagcacaaaatgaaaaaccatgtaataaagatattgcagaatacatccaagaatccgatgagacattatcttagttttctactttaaatatgcaagctccttaaaacttctatagatcaacacattatgtgatggtttcaatatgcctaaggtttgatcgtgtagtatagcgttgacttagaagttgtaaatggaagaattaccttttatttctcagccagcggaacctatttatctctttattccagatacgttatgtgatatataatgggcaatgaaaaggttggtcattagagcagctttaaaaaaaaaaaaaaaaaactcatcacagcaagtggaatctgtgttgaatgtttaactgattgtaactgaaaccttggcagggggatagagagacagaaatgagattaaggtagggacagttaaagaaatagcaagagtgtcattttgaagaatttgaatttgatagcaagcattattgtgagctgttgatgaggacaatatggttatgaacataagaataatctatcagtaatgtatatgaacccttaaaatgagagaagtagatgtcatggaggaagaattgtaattttatgatttactatgctgtgatgaggagtaggatggggaattgaggggtggatacgtaacatttttttttttactcattaaaatttccccagcccctaaataggttgtcatattttaaaactctttattattttatccttgattgtctggagttgccaagtatattagtaagtacaaaaagtaatggtattaagttttaatgacaaaaaaatgaatccactgggtataattagtataccaaactagaaagggcctattcaaagatctaatgaaatgcactcagtactttaatttaaattccacaaagtgctgaaatgctggtttatcttcccaattccctttagtgtcattggtataccacctttactattgtttccttaatgtattttttctgagtttgattcgacattcacctcaacatagatttgtaaatctacttttgtgaaagttatgcaactgctgcatttggacaagtcagctcatctatgaaataaaattctccttagtcactgtgaaggtaaaataaactaactcatgtggacgtattttgtaaatataagtcaatttagttatttttatttttagttatggaagccaaagatcgaatattattatttttaataatcacaaattagttgtttttatatttattatgggggcagaagctcataatattatttaaaaaattatcgtggagaaaattttaaaaatcacatattcctcaggataaattaagatttggtaagttctccctaacaatttatggtagtttcttaaccttgcatttgatatcaacagtattcaaatattagggtaatgatttgtaagttatcttttaaggagttgtctttgtattctattttaaattttctaagaaaatcgcacgttacttgctctccccacaccatttttatgaaccgatctcatatccactgggtatgcagttgaagtttaaatgatttcacaatacacgtttcctggcttttagacagtgtattatgtgtttagattacaaatagttagaaatctatttgcataaaattttaaattatttttataatgtcagtgatttaaaattattgataatttcttggattttgttctgttcacaattttttaaaataatgattgtaactgaaagagtaaaaatatccgacatgaaaaaagctacattaaataattagcatgttttaagttacagttgaagaaaaaagtgaaaatagactaaatgagatttttatcacatttccaagtgcaaaaagaatcatccagtgttggggataggaagtttttttttttaagataagaaaaaagatcattttaaaatttgactatggttttccatcttgctcaattaaaaaaagtcatagcatgtcactttcactgttaattacctaatcatattcaaagtcagtgattgacattttcacgaatccttatgtggcataaacacgcacacacacactgtgtgtgtgtatatatatgtttgtagaggtcccttgcttacctgtagcttttgacttagtgtattaataattcattttatgcaaatcaaaaccacaatgagataccatctcacgccagtcagaatgacgattattaaaaagtcaaggaacaataaattctggcgaggctatggagaaataggaatgcttttacactgttggttggaatgtaaattagttcaatcattgtggaagacagtgtggcgattcctccaggatctagaaccagaaataccatttgacccagcaatcccattactgggtgtatacccaaaaagtatgaatcattctgctataaagacacattcacacgtatgtttattacagcactgtttacaatagcaaagacatggaaccaatccaaatgcccatcaatgatagactggataaagaaaatgcggtacatatacaccatggaatactatgcagccataaaaaggaaggagatcatgtcctttgcagggacatggatgaagctggaagccataatcctcagcaaactatcacaggaacagaaagccaaataacacatgttctcactcataaatgggagttgaacaatgagaacacatgacacagggaggggagcaacacacaccagggccagttggagggttggggatgaggagagaaagagcattaggacaaattgctaatgtatccagggcttaaaacctagttgatggcttgataggtgcagcaaagcaccatggcacacgtatacctatgtaacaaacctacacattctgcacttgtatcccggaacgtaaagtaaaatttaaaataataataataataactcattttagttagttgtttaatgagggtatgtttttacccaagttctgcttttatgggagtactggatactaattatggtttactgttatatatgtatgtatatatatatatatatgtgtgtgtgtgtgtgtgtgtgtatacactcaattaactattttcaaatatttaaaaggatatatttaatccagtacatagaaaagcaaataacaatgtctagcataattttaaatgaagggcatttatgaataacacatacagtgtgatacaaatatatagtgagcctaccaattaagatctgataaaaaaagaggtacatggttaatattatcaacaaatggttactacagaatactagatgagggttaaaataaaatcattaatttgtatctgacgcaaaaataaagcagtcaaatttctaaagactgatttatgcatgtgtaacacagtcattcggttatctttctgtctacaataacttcaatcatttattttacttcatttaatattaagcaaaactctttgtgtgtggtagtttgtaggggaaagcaataggggtagtattttaaagtaaggcctctgaaaatgatgctgcttaatttgtcatctaggcactgccattattaggtatataattatagaaaacttactttctcaacccctcactttctcattcatattatgaagattaaaatatgcaaaaatattgtgagataacttatacaaaccactccagagactgcctggtaccttttaagcattcaaatgagccataattattaaaaagaataaacttatcctccagtgtatggtaattctgaaacactagatgtctaatagattttctcatttcaatccaaacaatatttattgggcccttggtatgtttaaggcattgtgcttgattagggacataaaaatgagtaagacagggtttccactctcaatttctcccaatttagtatgctccttgaaggcagtgtccatatgttttgatcatctgcagcatttgatgtagtaaagcgtatagccatgacatcacttaataaaaagcacagtgctatttgtttatatttattacaatgtcttcttcctcctgaagagttcaatgagtattttatcagtgtcaattctattatctacttaacaaatttgaacactgaggaaacagtaagggaaaaactgaatgctaataagcactcacagtctttgacaaatttgtgtctgcaactgcaggccaaggaagcatgagtcagagccacagtaatcaagttgttccatttttcttttgaccatgcaatgttggataccgttgctttcttgacttttccttttggtctgttttaggtgtctcagactcgaagtttgtgtgatgagaggagcacagtcccatagcaatgctaaaagatgtgtgtgtatgtatgtacatgtgtatgtttgtgtatccgtgtgtccaagcacacacacatatatgtgtttggaaaattgggttttgattttcatcattctgaagtttaattccccattagagttgattcactacataccaaaggatatactggtttattcacgtattcaaattgtactgagtggctggtatggtaagtgccatgagaggtacaaagatgaggatactgtggtccatttcttggaaagcccttaaaaacttactgtttagccactgcatgttctcactcataggtgggaattgaacaatgagaacagttggacacaggaaggggaacatcacacaccggggcctgtcgtggggtgggaggatgggggagggatagcattaggagaaatacctaatgtaaatgatgagtattaacccattagggtgcagcacaccaacacggcacatgtgtacgtatgtaacaaacctgcacgttgtgcacatgtaccttagaacttaaaaagtataataaaaaataacttactgtttagcatgtaatacatcaggaaaacaagtagttatatgtactacttatatgaaataataaaaatatatagagaaatattctcagtaagaatgtggaaattttatatttgtttttggtgctcactgaaagcttcgagaaatgtagcacttatgctaaaaattcaaggatgtgataggctttagaaatggaaaaatcgtgtagaaggacgttttggcaagagggaagaacatggctgaaacattaaagaggctattaatgtttcttccaacactctgcttattgtgagacctagcaggcactaaataattaatagcttgagttaatcagcttgtagttaactgaaaaagactgttctacagaagaaatatgacttctgactgactagaagtctactattaaggcctgaagacagctgtagaattcataatgccttcttcagttcaaaaaatgaaaaatttggttatgattcagcatcccatatattgaagttattatgtaaaattatttaatgaatttactttcttcatttaattcttctaatattaataaagtgcctacttctggatacatcagctgtgaaacactggtttcattctgccttttacctccttagatatgagggtgggtgaatttgctctttttgaccctcttctttagacccattcactgtccctgatctgatctgaacctagaagtctctccccagtcctcaggagacagacaggattgaaccccatgcagagagaaggtagtatgatggaattgaattcccggacagatgtggcattgaactctggcactttatctgagtgccactggtcataatgctgtaggttaatttcctcccttaaaaaaggatggaatagcagtctccttgaagtgttataagaattttagatggtacatgtaaagcacctgtaacattcagcacctttaacattaatgcagtaagcattcaacacatgtctaaatggaaggtgatggaaaagtagtccctccttatctgcatgatacatgttctaagaccttcagtggatgcttgaaaccacagatagtactgtgccctatatatactgtttttccctatgcctatgcctatgtacctatgataaagtttaatttataaagtaagcacagtaagacattaacaataatagctaataatgaaatagaacaattatagcaatatactgtaatgaaagttattttccttctgaaaatatcttgttgtacattcccacgggcaactgaaaccacggaaaatgaagctgtggatggaggatcactactatattattgttattattattattatttgaatctaattattagtctctaacaatagtgtttggtaaacatatctttattaactagtagagtgctttaggttaggaatgaacacaattaacacttcagacagtctccaaaatgttcttttaaaaaaatccactttatttcagctatattttgtgtactcatcttgctgtatgaaaattcttcaaagataactgcagaaaaatgttaaattgagaaaaggtgttttttgttttttttttttgtttctcaacataaatgagccttgtgtgctttcatttgcacatacctttaccaaggtaaaagtgtttatatattgtcaacaatgtattgatagactctgccaaggactggcttgtggatccctttggctcaatgcctgtttttgtaaagttttattggaacgcagatattggttaatatactgtctgtggctattttcacactacaacagagttgacaagaggccttatggcctgtaaagctgaaaatgcttactatctggtcctttgtagaaaaaatttgtccctatttctccacatcctctccagcacctgttgtttcctgactttttaatgattgtcattctaactggtgtgagatggtatctcattgtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtacattctggatattagccctttgtcagatgagtaggttgcgaaaattttctcccattttgtaggttgcccgttcactctgatggtagtttcttttgctgtgcagaagctctttagtttaattagatcccatttgtcaattttgtcttttgttgccattgcttttggtgttatagacatgaaatccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatagggctagccagttttcccagcaccatttattaaatagggaatcctttccccattgcttgtttttctcaggtttgtcaaagatcagatagttgtaggtatgtggcgttatttctgagggctctgttctgttccattgatctatatctctgttttggtaccagtaccatgctgttttggttactgtagccttgtagtatagtttgaagtcaggtagcatgatgcctccagctttgttcttttggcttaggattgacttggcgatgcgggctcttttttggttccatatgaactttaaagtagttttttccaattctgtgaagaaaggcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacatgtatgtttattgcggcactattcacaatagcaaagacttggaaccaacccacatgtccaacagtgatagaatggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagaacacatggacacaggaaggggaacatcacactctggggactgttgtggggtggggggaggggggagggatagcattgggagatatacctaatgctagatgacgagttagtgggtgcagcgcaccagcatggcacatgtatacatatgtaactaatctgcacaatgtgcacatgtaccctaaaacttaaagtataaaaaaaaatgttcaaggatgcaaatttgaagggaattctcaccaaaatttatagacttgtagaagcataaagactggaaggaattttttatccttcaattattctaacttcatataaatgtattggaatccatgataaatggtaaaaaaaaaaaaaaaaaattgtcaactacacttttacatttagtgtgccatagaaaattgttttacaatttagggttttatttttatagaatatcagccttttatgactagtatttataattgtgaatattaaaaatatagtacacatttattcaaatttgatggatttgaataattagggaacagaattgatatctgcttagcctcattagagtgaatattatggtaggtttcagaaatacagtttctacttttattttatcatttacagccccaattaaattctcttgcctttctttctaggacaattgagaaaaataaaaaagtgcgattgacaaagacaatgtagttcactatagtggagcatctgagcttcctgacaggctagatggaaaaggaaacacagataaatacttttttaatcatgagaaaataggaagtgtatcaattactacagtaaaataaactttatcttgatgctggcttttaatgaccttaattatatgagctattgtgaggcagtatatggtagatgttaagaaggataaaattggcatcagggagatataagactgcagtcctcatatactctctggccgtgggcaagttacttattcttttagaaattcagttatgtccagttatactataactacaataaataggtaccgtagagaatttccccatacacactttcatttgtcttaatttatggtgagactatctataaaaacagaaagcattaattttaaatattaatatatttaaggattacttaaagttaaaaacacatttccaaaaatttatatttttagtttaaagtatgcacttattaagttgttaaatatcctgggcttgatgtatatttaaaaacaaagaatttaaggaaaccaggtatttggaataattaatgggcatttaaaaaagttatgtttataaattgtagggttatatgtacacacaaaaagaaatttaaatgtaacatacataaggacaacgtaaaagtttatttcttaaccttcttaatctacttaaaacttttagaaaagctcttctttcagacataaagatcagccttctgccattagcaaaaaattggaaaaatagaatacacattttctcatctaagcaagtatttttagagtcattatttttatgttttttttccaattgaagaaaatatagggtgcatatcaggaaatacaatctgctagtatcactaagaataaggaaactaatgttgacatatttgactcgaagaaaacaaaaccattattgatgacatccatgtttgaaaagaaaggaaaagtgtttttatggaaatatgtagtgtttaacatccttagaataaagtacatttggtgatatttttaaaaggttaaacaaaggcagatcttcaatataatgatatttatctccattttatttctggcttttactttgatattaacagaaatatatgcacagacatattagcaggataaaacaagggtcatgataaaactgaatttatttttgtttgaattataagtagttttacacattaatgaaagtccattgttatggttaatcccctggcaacttgatctgtgtaatgggttttcattttctttataaataattactcgctgtttaatatttcaaaaaactatagtgtaggcatattgacttgttcaataaagctcatttgtattcattgtggactcttgaatatggactatagcagccagtgaaattggtggtgttttcttgttacgaataatacaaggaaaaacccaaatctattcaattaaatttttgtgtgcaaaatttcagctatagtctaaaaacgctacataatttatattacaatcattttggctaatcagatacccaatcatattttaatagatttccctgggagaagaaatgggatttaagcttattaatctgtatggcatgcaattaagctaacattaagatgaccaaaccagtatgttttattccatttggaataggatcacttctccagagtagtagatatttcggaatttacaaagaccaagaaaatgtgtattcctttatgatttttactgcatgcttaactatttattattccatcttgttcttgaaagatttttaagttctttataaaaatacatacattacaaagtaataatacgtagaggagggaattgggacagtgttgggaagaaaagctgtgccagaagtgaggctgtccagaggtggatcataaatttgtgtctaaactttttagtactcattgcaaaaaaacatgatatcaacataattccacctttatgaattgtaactttttttacattaattactggagctcagatcttccattctagatacaaacaaaagtttagttttaatgccagatcatttaaaggcagttactttaaaatggcatcctacaagactactttctgtcagctgcctatttccacacatctataggttaaataaaccaatattgaataccattggcattacattttttcaagatttgaaagtgactcatgaatcattaaggagaggttgaattacgtcaagtgtagtttcactactacatttaactgatacttttaaaaatgtactcactttcatatggtgcataaagctctgttaactcaaatattttcattgtccttgatatttaatacctcagttattgatagcagtcaattgctcataaccaaagaaatgcaattgacatagtgtaaaagttcaatttcagtgttctttctttaaaaacccttcaaaatgagttttaaaataaagtaataaaatttctaagtcaacacttagaaatctagataagccaatagtttcatatagcgtcttcaatgttacaagatttgtgagtactggcatgtgggtcagaaaacaaggggtttgaattccagctctgctccatttttattgcaatttcagttatcattttagcacttcagaataaaaaagagatttatttaatttctaattttttttctacctctcagctttttttcaacctgtgtgtgactggattgcccccactttagttaggttatcataatatacctgtattatttaaacatacacaatctcattgtcacttccccacaaaattaaaggaaaagctctctaaaaaatggaaaatttttagcacttcagaataagagatttgtttaatttctaaatttttttctatctttcagcttttgtctatctgtgtgtgactgaattgcctccactttaggttatcataacatgcatgtattatttaaatatatacaatctcattgtcaccttccccacaatattaaaagaaatctcttcaaacaaaatggaaaagattctgaacaacgtgaacctaagaggcctaaaaatgactaggcaaaacaagtgaagttagaagtgataaaggatattgggagaaatacagtaaagacataaaaatatctattctcctttcctcatttacccccacattcatgtcatttgcctggtttatttacctgaagatatatgcccattgcagtgaaactgtatcatgtcattttatgctacacgtaaacagtaatggatatattaccatttaaagcatattaacctattcatgatgtgaaagatataattgatctttaaatgttttatgcagaaatccttgatggattattagttgttagactattttgattggggctctgggtgcactggaaataaattattgtttttatcatttaaaataatgaaatatagactcctactagccaaaacattttatcaaacacgtgacaggaatggattacattgatataatgacggatatatgtaactgagataatctcttcatgtatggccatagttagagataagatttgtgctatttttttgtttttcttgataagttgttttttcttccttcttttgtgataatttagagagttcacttttggctctttaaaagcacttcacacatactagagtctttacctaataaactagatcttcaaatacattaggtcgaatcattaaaaattactaatcttgtataaggtataaggaagggatccagtttcagctttctacatagggctagccagttttcccagcaccatttattaaatagggaatcctttccccattgcttgtttttctcaggtttgtcaaagatcagatagttgtagatatgcggcgttatttctgagggctctgttctgttccattgatctagatctctgttttggtaccagtaacatgctgttttggttactgtagccttgcagtatagtttgaagtcaggtagtgtgatgcctccagctttgttcttttggcttaggattgacttggtgatgcgggctcttttttggtttcatatgaactttaaagtagttttttccaattctgtgaagaaaggcattggtagcttgatggggatggcattgaatcttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagctcactcatgatttggctgtttgtggttggtgtataagaatgcttgtgatttttgtacattgattttgtatcctgagactttgctgaagttgcttatcagcttaaggagattttgggctgagacagtggggttttctagatatacaatcatgtcatctgcaaagagggacaatttgactccctcttttcctaattgaataccctttatttccttctcctgcctaattgccctggccagaacttccaacactatgttgaataggagtggtgagagagggcatccctgtcttgtgccagttttcagagggaatgcttccagtttttgcccattcagtatgatattggctgtgggtttgtcatagatagctgttattattttgagatatgtcccatcaatacctaatttattgagagtttttagcatgaagggttgctgaattttgtcaaaggccttttctgcatctattgagataatcatgtggtttttgtctttggctctgtttatatgctggattacatttattgatttgcatatattgaaccagccttgcatcccagggatgaagcccacttgatcatggtggataagctttttgatgtgctgctggattcggtttgccagtattttattgaggatttttgcatcaatgttcatcaaggatattggtctaaagttctcttttttggttgtgtctctgcctggctttggtatcagaatgatgctggcctcataaaatgagttagggaggattccctctttttctattgattggaatagtttcagaaggaatggtaccagttcctccttgtacctctggtagaattcgactgtgaatccatctggtcctggactctttttggttggtaagctattgattattgccacaatttcagatcctgttattggtctattcagagattcaacttcttcctggtttagtcttgggagggtgtatgtgtcgaggaatgtatccatttcttctagattttctagtttatttgcgtagaggtgtttgtagtattctctgatggtagtttgtatttctgtgggatcggtggtgatatcccctttatcattttttattgtatctatttgattcttctctcttttttagcattgggagatatacctaatgctagatgacgagttagtgggtgcagcgcaccagcatggcacatgtatacatatgtaactaacctgcacaatgtgcacatgtaccctaaaacttaaagtataataataaaagaaaaaaaattactaatctttaactcatttgacacataagaatgacaatttcatatattttatttcccacctttcattttatttttagtctccatttaatgataactaaattttaaatattttaagaattttaatcaagcgcttctcaagatatgattaacttctataattttattatgtatgtatatgtgttaaatatgtaattattatttgcacatattttacctattccaatgtctcttactgccttcaacattcatttctgtttcttttacacaacaccagcctcaatttgttagtgtttttttgttcgtatatcactgattttgagtttatctctgatcacttgtagaacgggatttagtttttttttaatgttttaaaatattggccaggctcggtggctcacgcctgtaatcccagcactttgggaggccgaggggggtggatcacgaggtcaggagctcaagaccatcctgaccaacatggtgaaaccctgtctctactaaaatataaaaattagctgggtgtggtggtgggcgcctgtaatcccagctactcaggaggctgaggcaggagaatcgcttgaacccgggaagtggaggttgcagtgagctgagatagcaccactgctctgcagcctgggtgacagagcaagacttcctctcaaaaaataaaataaaaataaaatattatttatttatttgtaattgataaatattgtatatatttattgtggacaacacgatgttttgaaatatgcatacatttttgaatggccaatggagccagttatcatatgcgtcacctcacatacataccatctttttgtgatgagaacacttgaaatctattttttttagtaattttaaagaatatattgatattaactgtagtcatgatgttgcacaatagatctcttgagcttgttcctcctatctatctgaaaatttgtatcctttaagcaacatatcttcaaccctgcccagtcaccctctggtaaccaccattctactatctacttctatgagttcaactttagtagaacatgaatttgaatggcttcactcctaacgctgtacacatctgattatgagggtcttttcatttcctatgggtgtgattgaaagcctgaatgtatgtaaatttgggggtcataacgttttcttgcaatgtactatagacatgcatgcaaatccatactggggcaagtaagctatggagtgtctgtgtgataggctttagacattaagaagaggaagtgataagtagtagaagaggccagcatgattccttcaaggattatgaaggaagatagtaaaagtcattttttaaacagtttgtctactttagatggtaaggcagctaaagaattttgcaaaactcctctaacttcaaaccttctagaaagggttagaggatctcatgtcatcaaacagacccccaccaacaggagcagatggggctgaatgtagtttctccacttccgtagagttttaagtaaatacagctctaattacaatttgtattggacattgattctaataatccataataatgaattaaggaaagctttagtaaaataaagagaaatgtctctgacaaaaaaaagtttttctaagtaattagatgggaataaaatgtttactgtcatttttcttttgttacagagaaaaaagatctgaagataaatatcttcagctctttttaaaataacctatattttcctctttgatgtttatcaagatacgtgacgatcagcatattttaactataaagaaatgtaacatcatttttgaaatgaaaaagtaaggacaaataattaaagaaaattacttataatcttactaccccgatatttgtttagattgacactttattgtgtatctaatttttaatacatatttcttatttaaaataaaatgcagatcgttcagtacaaactattcataacttgctctttttacatgcaaggaaacattccttaatatccttacatattttaacactctcatttataatggtgcatgtggccttttatcctagtgctgtatttttaaaatcaattataaatggaaattcattggaatgtagttaataattttatttcttctcaaatatcttttcataaaaattgtgccaatttatactctccagtataagagagtgtttgtttcatccacttatcaccaatattatttaagcctttgccaatttggtaggtgaaaaatagtaatgtaattataattccaaattatttagcaattcatttgaattttatcatattttcatacttaatacaaatatgtttctcttatgtagaattcaggattatgttatttgcatatttttattaatgttttcttactgatttgtaagatgtttatgtagcaaggacattcatattttgcattctgtaaatatttggaaattttcttttagagatgttaaacattattcacttttactgtattttggatattttttcctaaatttctgaatcactgatttgattttctgcagtactaaatctgagttgtattgcttgtagcacatattttatttcaaccattgcagtctcatttctttttactttaatttcactctacatttatttaataaatgaaatgtgctcttttctgtccctgaacatgatgtaatgtaactacatatgtttataccatggctcaaatggagagaagaggacccaggtaacaaaggagaaagataaaagatagataaagatacagttgcatattggataaagtcactaatttgcaaaggtcagaagatatttctgtgcagaaaaggaattggccattaggtaggatgaggcacgtgtatacctatgtgttaaattatgtgttaaatatttgtcattttacagatgatcgtagattcctgctaaaatctcacatgacctcagttcctattactcattaatttttctcctgaatataacttcattatcatgacgtcatgataagttcaaaaagcattaggaaaagggggtttagcatttttatttacttcaacattttaaagtatttcccagtatgtgtctttaaaataatctcttatggaatatcaaaagacagagggactgataatagttacggcttgagtcaaccaaactgttcaataggaaatagcatcagtatattttctgaaaatcctgccttttgcttgaatattatggccattttgttcaaaataaaaatactcagcaaaacccttaagagaaaccttcaaaaggacaagtacatgccaagtaatctatattgtaagtgcaagggcaaagatacttctccatccttatattgaagcggttgaaaatttgctacacattgctagagttctccaaaattgtttagagtttattattattgttgttgctgttattgcagttgtttctgttaagaaaatgtgggtaaagggccgggcgccgtggctcacgcctgtaatcccagcactttgggaggccaagatgggcggattccgaggtcaggagatcgagaccatcctggataacacagtgaaaccccgtctctactaaaaaaatacaaaaaattagccaggcgtggtggcgggcgcctgtagtcccagctactcgggagtctgaggcaggagaatggtgtgaacccaggagacggagcttgcagtgagctgagatcgcaccgctgcactccagcctgggcgacagagcgagactccgtctcaaaaaaaaaaaaaaaaaaaaaaaaaaagtgtgggtaataagaggaaatatttatgaaatcgggataaatattgcgagtaatgtaacaaacagatagcttatgcccataaaatgctacattttactagctacggaagggtttgagtccactaagaatatacagaaagtacttcttgtacatcctcatttgatactgttgttgctctgatagggaccacatagcaatgtaagcacaccacagttaaagaatggttgaaaatagaacttaaggacaactgtaaatgacgtttggggagctattttctctctgtattttattttatttcatctcattttattttactttaagttctgggatacatgtgctgatcatgcaggtttgttacataggtatacacgtgccatggtggtttgctgcatctatcaacccatcatctaggttttaagccccgcatgcattaggtatttgtcctaatgctctcccaccccttggtccccaccacctgacaggccccggtgtgtgatgttcccttccctgtgtccatgtgttctcactgttcaactcccacttatgagtgagaacatacggtgtttggttttctgttcctgtattagtttgctgaggatgatggtttccagcttcatccatgtccctgcaaaggacatgaactcattctttttatggctgcatagtattggggagctattttctatggctgactttgttacccatgtgactgttcattccccctctcccaaattaattataattgctttggcttcatatttaaatgttccatatattgccagttgtctcctgggaagcaaaattgccactctttgagaaatattggtctagataaatagataccatttaatttttttgagacaatagtatgaacttttctatctgtatagacatttgattcagccaaagaataaactagattgttaaatcttatgtttcttatataaggtgttactctcacgttaagagcacccaaactatctaaattcacatatttacatcattttagcccttaagacatagcctgggaggaaaaagtatagcttaagaatggcataagaagatatatatttgttcttttctgaaatttaggaacatcaaatattttgctatgagacctgtcttctttggaagaaaaattatcagatttgattttgataatctggttctctattggaaaacataaacattcaaatgactaagcttcatatagggctctctagcaatgttttgttttctagtccgcttacacattatgagtataatctttaataatgttgaagatcctttggcttaaaattcaaactacctcttcttatgtttagcttatttttctggcagtaccactgtggtttcagataattttcttttccttttactctctcatttccaagtttcagttattaaattttggcatttgagacccagaatcctggtagtaagacttttgtttaatttttttctcccaaaaattacatttgattttaattatgtcacatgcacagagagcgctccttatccatgtgttctacatccatgtattaaccgactgtagattgaaaatattcagaaaaaaataataagtagttatataccaataaaaatattataaataaaacaatataacacagcatgtgttatactgcacagtatttacattctattaggtgttataagtaatttagagatgatttaaaagtatatgggaatatgtgcatagattatatacaaatactacaacattttatttaagaaatttgagaatcctcagaatttggtatccgtggggggggtcctggaaccaatcccctgtggatactgagagatgattgtgtgtctgtgtgtatgtgtgtgtgtgtgtgtgtgtgtgtgtgtgtgtatgacatgttgcttgttggctttattagctactatcaagtttttatactgcagcattttttaattcatgattttgataactccctcacttacttagagtgctttttgaaagattttgttcaagaaaaatacatgggtaatatgttttctaggattctctaaattggaagatatattccacttctgtaatttcttggctgaaaattcaattattgaatcacaaccattctttgaaaaaaatctgtgggcactgcctcaacgttatttgacttttaatgttgcaaaggaaaatgacaatttggatttttattcttttgagtgcaacttgtttttgctgcctagaagtatattatacttttttctttgcctttgtcgtttaaatctgtggccagaatatgttcatttttggttgtatttcataaatattgccttaataaagatgatctctattttacattatatattcctctgcatacccccaatatatctatatcaatttatgaatcaattgcatgttttactcttacaatatatctgtaattgatatcaataattaatacatagaaattaataaatatatatacaagtagatgaagttaaaattaatgaaaattgaacttctgatatattcttttatgctgcaagggattaatcaatgcgatgtctaggaaggtgcccatcctcctttgaagactatggtcctggaacaccgaggatccttaaatatgcatgtttgggtgttattacttccctggaaagttttcagaagttgtgtgtttaattctggcgttgattttaactgctcttgttccatcattccagaacctctataattcttaggtgggcttgtttttctgtgcaaacttccatcatcttctctctcttatttcttcttttcctaaaattttaattgtggtaaaatacacaatataccctatttcaccttacttccctcaccctaccccaccttcttgcagaaacttattcctttcacaattcattatatttttatatgtatcattctactcaattttctctgtgtattgtgcttatatatgtttgcataaattatactctatattgttttctgtgcttcgtaattgtgacttaatcatatatctaggaaattgtttatgagtgtatatttaaatatgacatcatttaaagtaatccttgaaaatattttaatacttcttttagttttataaatagatgtgagtggttaaaaattcatcagtgtagaatggtataacataagaagaagccatcaaatgcttccacttccatctggcaccaccatttttatttccaggaataaacacatttgagacttgcctatccacttttaacataaagtatctacgcatatacagacatatgtctattaagtaactggcttcttttttttacataaatcatatcaatgtgtctctgcacatatagatttctttatttccctttatttgctgcatagtattccatacgatggatatattttccacttaatcacgaaattaaccattcattttgttatgggtggttggctcatatacaaattttgttattaagatgcatgatatggtgcttattcatttacacctatttttgcatattggtaggaatttagcagtggaataaatttctagtagccaagttccttgggcaaaaggtatgtgcagtttgtttctagatatttccaaattattcccccaatttttacactatttgatgcagcataaatttgcttctttgctctttaagtgcaagttttaatttttccattttatttttctttctggattttttctcatttcttggcatctcaaaatgttctccttttgtgagacctaggtcttctcttacatcctatttgggtaagcaagtagtcttgaaataatttccataattcttttttttctctaaggtttgggatcagagtcacagtttatggttttgaagtagttttttaattgcgtacatgcatgtgtgaatttttcttttgactatttctggaatatacaccttagtttagttctcactaaagataacttgtttgtcttgttcttggctttgtatactctccacttgtgtagaattgtaaaagaatgttatacacacacacacatagacacaaagctcaatctcatattacattagctcagaagtcaaagtcctttaagaaatgggtgaaatggtggtaaacaatttatttttcatccatacttaggaaatgctcattccccatactacaggttgaaaaagaacttcaaatttctcttttaaacatcccatataatagaattgaaccttaatagtaagataattattaatgtgcatatgagtaagtttattatttaatatccttaaattagcacctgcatttcaaggtacagaatttgggttaggttccagtttgatcatttatttaagaacatgttgagcttatagaaggaaagtgagccttttttctctctcagaagacaggcaacaacattaaaggtctgaaaaaaatgctttttgcataaaatagtttacttaattgaacagttttttgctccccttaattcagttcttttacctagtagagaaaataaaccttaggaattaagttatagtctctaaggacagcttcaaaacttcacaactcattgaactggcataatatcagagagacttgcacttgattttattttaaatcctctagttctttgcctataagattggcattgatttcagcgtagctttcaaatgggcccaggttgcaatatctgtctatcagggatacaagtactaatgtgataaaaataataaagcaatctgtgcgctcttagtgattgtgtccttatgagatttcattttcctttataccatgaaattatttagtaaagccatctatcataaagagtgctgttagaaatacaattttctcgtgacgaatgatgtaaaagtaacctttttcaggacaatttattgattaatttgataaacatgtattttgtgccttttattcttggggcaccatattaggcatgtactaaaaaatactcacgaagcccttttaattctttgaaatgggttagatggtggggctgcataatggcaccaatattaaatagacattaagttaattaaggtgcgttaccttagttttcaaacatatatacacataggtccccaatttagagcaaaacagaaattttacaattagacttctaatgaaacttgcaatttttgttagaataagccaatctttagcatttataattgccaaattatgtttctctgcttttctgaggaaatacatggttatgctttgttttctgaagcataaatggatgtttttacttattagtcacttgtgagcagaaggtattactctcgttccttttatttcctcttcttccaattagctgacagatcaagaattcgaaagatgagaatgccttgaggtattcagatgtcatctacaacagggaagaagggtgactgtgagagtgccaaactttgctgctggaaggcagtgttatttcttgaccaactcatgtgcattctaatagtcagtgattttgcttccttatgtggctttgcaaaatgatcgtcctctgccaactctcccccctcctcttgttgttgcttttggtttcagtctgtatgacacaggagcgattttaaagcctttcatggccagtattgtatataaagaacttagtggttgcaatgtatcaattaagcaaacccaaaagttatctttatacagctgtagatattgaatgctaaaacactgttttatcaaatatttggttctaatatcatcatctaaattttaatgtaaacgtctacattaaacttttactggaacagttacagctgatttgaggtctactcctctagattagtgacattttctattaagcatgatttattttttctttacctgtaatcatttaggcaccacaaaggaaaccattgttattatagtctagagactagagcttgttggaagctttctgaatgtttttccacaagaggtggccaactcaattaggactggttcaatttttgtcaggtttagtttggttgcaaattccaccttttggtttgtaaattgattgctgctgtgatataacacaatgaccaatgggcaaaagctaggccaaaacagtgaccaaacagttgagcttgtggaactggtctcctttgcccagttacatgaacactgcaatagtttctaacttctgccactcaaaatatgtgaagcttctctaccaaagacaaggctccctttgcaaagatcacttggtagctccatcctgctggagttggtgtaaccgttcatgatttaagtcatataaaataggcactgaagctttatatactattggccacaatcagtttcataagtcttatattactctttcagcctcataaatgttcaatctcaaatctagtatttagatttatatataacttcctttccttctttacccttatatctacatactgttctaaatcagaactctttaatttagtccccttggccaatgagaaagttaagccattaaaaaaaaattctactttcaatacataacaaattttcttcttattctttaaattaaagatctccccctaaccctttacctttaaatcttttgtctttctaggctcactactttggtgatttacctattcccatgaccttactcatcattacaagcacttgacatttaaatacctagatcaaaccattcctgagttgcacatcccaacttctaacttccttatgaacatcactagttgcctgactatatattgacatgcacaattgagagtgttacagtgcaggcatgcacagcctaacaagcaagatacactcactgaatgaatgttaaagtggaaaaagtcttccaccttaaagattattttaaataatccctaaggggtgtaaaaatcatctttacttacattttaatttgtaaagaggagaaaaatattgatgaagcagttagaaatcttgtgcctgagagagagcgtccctcacttttggtccctgtagtgtgtctcttttcagttacagtaagtggcttcccacattcttttctcataagggcagtgcggccagatggcatgctacttacttattgagaaacaaaagagaatttcttccttacaaatgttatctaaaatgtagttttgaaagtctcttaggtaaagatctcctttataaaatgtaatatataattataagctggtggacttctttttgatctctaagattattttgggtatacttagattactgacaacccttagtcaagagccattagttccgtagccattagttaattattactgtatataattattagttagctaatgaagtgtaggttattattaatttggggggctgagatacaaagtaacatcaggtataaggagtttatggaagttcaaaaatgcaaattgtgagttatttcatactcatgacttatcatatggaagttctggtcccgccacttccagactctatgatctcaggcaggcaaataatttatgtccctcagcctctttaacccaagcgcaaagtggaataataagattggcctcacaaaactactttgaggaaaacattagaaaatacatttgtaagatgattctataataaccaagggaaattgttaataaatcacagtattcccataaaataacatgagttaagcattgtgtagaaggaaaataaatttcaaatatataataaatatggaagcaatgctcaaaattcaattttatgtgaaaaatgcaggaatcaaaattctacagaggttatgcaaatttatgtgtatactcacatatgtgcacatttgtgtgcatgtgtgtgcacatacacatatagagatgggatgagtgcagaggcaataacaaaccaggaacagtggtgggaatacatgttattttctttatatgtttctttagaagtgattagtagtcagacttattaggtgttgtatacactttttagactaatttattgaataaaaacaaaagccatttttaacaatggaacaattggaatttgttgttttctatagtaaaagctgtctatcttatcattcattcagccctcattctttgacatctgtatcaaacccgtatgctgtatggttaagccaactaatggacagtacatccttcaataaggaggaagtctaaaacacatagcttccaacttgctttaaaccagatcttgttggtgtgaagccactgtatagttatttttatttatttattcatttaaaaggatttccaagctggggttttggttacttattaaaacctacagagacaaacatgtgtttgaaattaattgtgttattccagatttttcttataccattacatcatgctctttcccaatctggcttcctgaattttcttcttaaagttacatgatttttagtctcattctcaagagacttggaaatgtaaattgagttattcaggcaaaacactgaatttcaagacattgttagaagccagcttcccattatatagaaagctttttttttttttcagtgtaggcatttttgctcagtttttagaagatttagaatgtaatacttgaatagccaaatactgatttcttaatcctatctattcatgtacattaattcctatgatgatgtttgttaggtttacaatcttggctggtcttggtaaggtagattaaaatattataggttttagactctcacagcagtaatgtccaccgtttttctccctagtgttaattttttttaatactaagaaattgtattcttagatattcgggaatgcaaattttatactgtagcactatatatttcggtctttggatagacaatattttggcttatttttttcaattcatctttagaaacatatatatgtttctaaacatatatgtttctaaacacatatatatatgtttctaaacacatatatatgtttctaaacacacatatatatgtttctaaacacatatatatgtttctaaacacatatatatgtttctaaacacatatatatgtttctaaacacatatatatgtttagaaacatatatatataaagataaagttttgctcttgttgcccaggctggagtgcaatggtgcaacctcggctcactgcaacctccacctcccgggttcaagtgattctcctgcctcagcctcccgagcagctgggattgcaggcaactgccatcacacccagctaattttttgtatttgtagtacagatggggtttcaccatgttggccaggctagtctcaaactcctgacctcaggtgatccacctatcttggcttccctaagtgctgggattacaggcgtgagccactgcgcccagccaaaacttttacatctttatgttgacataaaattctaaactatgtaagcaagcttcactttttttataaggatttagaaatgaacaaaatgggtacacaaagaacagattctttatttaacaaacattaattcattgaacaaatattgaagtgtatactttgtatcagttatcatgtcaatcatactagaagaaataagttccaattgtgtcaattggatgttctaactgttcttaacttctatgattcataagtttataactccctaataaatctttacatataattacgttggagtatcacaataatgaataataccattttgcttatataagctttgtgaatgtgaaacaaaaagcaacaacagcattgaagttagaaactcttgaaataattttctacaaaaatttatcctttttaaaaaaactaactttttaagctaagcagagttcggcctggttagtacttggatgtgagaccacctgggaatactgcgtgctataggctttaataaaacagaaagaaaaccctaacttaaaatatatatgtaagttcttaaaaagcatatcttgccataatttatgaaaacccttatatatataatttttattgtttttcagccacataataccagtctaaaaaagcacatgtagaatatttatatgtagtatatatatacattcaactaccttgcatatccagtctcatgaaaaacaaatcaaaagggaaagagaagtatagaattttcagtgtagttaagccacactgctttccctgattttgaaaaatcacttaagacataggttttacttgtttccttggccagggtatgatggattacctgtttcacaaccatctcagtaactaacaactgccaactacagaaccgtattgttctaccaaaggaaaaccatcatgagaagataagatgtttttcccctaccccattgaaacttctaaattacctataaaattgtcataatgtattagtaattggaaaattctgaatgatttttgtttatagtcttaaaatatatggatgaaaaaagaagaaacagttttggcaaaacaagctcagaattcttgatgaagctgttccttggagtcaaagggagtgtgatgccattgccactcaaggttctccttcgtaatctctagcagataatctataaatcccaatgacctataagagcaagacaaggactgcaggtgctcaggcaccatgatatcattagcaataatcaatgcatggctgtgttttctcactaatacatgggtagagtaccaaattattgagcaatactagatctctcttttatcgagctcattagtcttggaagaattcattaatcttttaagcttagaagaaaaatgtaacctaggatttggcagaacgatcaatgagacatacgtgagagagtgtgtgtgttcaagaggaaggtaaggagaattgaaagttttagcattggatttagcataggatttaagtggacccatctgtatttggggatgagggggaggtcatacacggggctgccaacatgggtggagacagaaaacaaataactctgaaaattgtgtgtgtgtgtgtgtgtgtgtgtgtgtgtgtgtgtgtgtatttctgtaacagtttagggttttaatttttttccagaaaccctaatcaacataattaactttctagcctcagatctaattggtcactacatcctgtcatggccaccaccaaattatatcttatttacttccttcttttatgcctactgccggaaacttatttcaaagatacctgtattttcatctgaactgttgtaataacctactgactggcttctctattattttcccgtgttcatcacttatattgacttccttatttaaaagcagtccagatctattcattgcctacccatgaaatccaaactttttggcatgaatttgaaacaataataattattattatcatttattaagaaacttacattgctagacataaaacatgagtatctccaactcccaaactgagctttgaagatagggtattgttatgtcttgctttgcagcagaagaccttgatatacagaaagattaaagatctttccaagttcaaggagctggtgtaagagacggaactaaaattcaaaacatgtgctgtgggtcgggcgcggtggctcacgcctgtaatcccagcactttgggaggctgaggcgggcggatcacaaggtcaggagatcgagaccatcctggctaatacagtgaaaccccgtctccactaaaaatacaaaaaaattagccgggcgtggtggcgggtgcctgtagtcccagctacttgggaggctgaggcgggagaatggcgtgaacctaggaggcggagcttggagtgagccgagatcgtgccactgccctccagcctgagcaacagagcaagactctgtctcaaaaaacaaaacaacaacatcaacaacaaaaaaacaaaaacatgtgctgtgactgcagagttcgggcattttccattacacctggttctgtttaaacctgacccatttcacctttatagattcagcaactaccagtctcaccttctcgtacatcttatacatatttagctttacccacccgccatgatttaaatctctcatactttttcccatcctcatcctgttggtcatgcccttcctgctgttgtttccttgatctttagtaattttcatttagataacatctactaatctctccaggttctgtgcaaatgtctcttcttctctgaagtctcttttaacctattgagttttccccttacccatgcaatatttccagagcatgtgatacatacttctattgctgcaccaatctcatttttgtagttatttatttgtgtatccataagtcaccatgactgcttgaaaacagagcacttttcttcttactttgttgtttatgacacagtgattgtcccatcaaacatgctcatacatattgaatgagtgaattctctacccatctcaaaccaatgcgttatggcaatggcacacaccattagtttttgtaagtaacttttgaaagttaagccaaaagtatcttcatgttaattaatagtgcaattttgcacgtgttggaatagttgagaattggttattcttaagatttatttcctgcccaaacaccacagctccatatttcacgattttccaatataacttatcatcttggctgtaaagaataccttaattttggccttaggtaggatagatatgtttgattggactttctctgactgattaggttaatttgtcagctggactcacggttcttctttagttttcttctattctacacttatgataactctgtgtttggatatttctttgtttattacagatattaaacttgtaaatttaatgattctctgtaatttttcagagcccatcagcccaggtgtctttccacatactgatgtagtaactgtgagtgcctttaaagctcttgtatctaaaccatagctctgttatggttagcctctgcttcattcatttaaaacctattttgtgtagtcactatttgcaaagtgtttagctaagataaaccacgtactttccctgttcttgagaaattcatagtgtatcctttggtttatgatctagcctaggactcaattagaacattaattttgaaaagttaaaggagacctctttggagattatgcgtttgttttagttgtgctattagtgagtttaatcatataattttgctcaaacaaatttcttaagggtctactacgggcctgcagagggggaccaagggctcagaataaattgatgtagtggttacagatgctggcactggattaaacctggatgtgactcctggcttcccccatacttgctgtgtgatgccctgcaagttacagtaactatctgagttttctctttgacatatgaaaaatgtaaataatagtatttcccatataggtatttggtgacaattaaatgagataattaaaataagcataggacattatatgacctttgctaaacgtccaatttttgttgtttaattattgagttttcaataaatatttgccaaataaaaaacttaaggaaaataaacactgaagttattgtcatgactttcatgtatatctccattcttgaagttttgacagagttataaaaattgaactccgagttttggctcaagaaacctctgttaatctgatatgcataaatcttgaattaaggtttcctttactactgttactattcctactgataatatctttttatagcatttatattttaatgtatatttcccattacctcctaaaatccttagagcaatccctgtgagggctggtattattttcctttatagatgaatagactaacatgtgcagggattaagagtcttgatctacgccatttggctcataaatggccagctcagtcctggaactcccaggtgtcctactcctgtacttcttgcctctcttccctaaattttggttagttgaaaagtggacaattatcatcttctggaatcttctgtatgtaatgtaatatagttacagtgtgtttatatagagtggaatataaggagatggagattactggcctaaggatatgtatagatataaatggaatgtgcacacacattttaaatgcatgctaagtggaacatggaagtttttcatattgactcaaagtgtggtttatttgaagacattcaattataaatgtcaagtcaacttgcattcaagtaaattattatgtccctactcctaaaatttttaatacaaagtcatctggccaatgcttatctcttcagactcataccccgtcatttgttctttttttcagaatcaccatatgattcagctgtatagaagtattgtggtgaatacttgtttcatacttctgtcttattatattccctctatcagtgtactccctgccccttctgcaactcttgtttatcctgggaaatgctggatgatctttgaagatagcaaatgcttgccccctctgtgataccatctttcaactctgtagattgaacattttctggcacttatagcactttaactgtcctatcacattaaacaatgttgatctaagtcaatctgggattccttagctctagtacaaaacctggtacaaatgtggaaacaattaatatttgaattgggctaaaaaactaggatacatgtttctttgggaatttgctgaaggaaaattagaagtaaaaaaattgagcaactttctaactgttttctttcaactccaagtgttcattcaatctgcacatgttcctgaacacctatgaagtctcttctcctaaccagggatccagcagtaaatagaacatataacaatcctaccctcatggaaaatgttttctaatgtaaagagatatacagtaagtaagataaatatatgaaatatcttacatggtgataaatgttttagagaaagataaagcaggaaggtagaatatacaatactgagaggaacttgcagttttaaataggatgggcaaggaagactctgctgaataggtgatatttgagaaagaggggaaggagataaaggattgaggtattaggatgtctcagggaagagcatcccaaatgtaacagcaaatgcaaacaacaagagaaatgaacacgtatgtcatgttcaaagaagagctcagaggccagagtggctggagcacagtaaagaatggaggagaaaaagaagacaagttcataaaaatccataaaaatcatgtaatgtcttgtaagttaaaagattgatagttaatatgagtaaaatgggatgtgaatggaaggttttgaaaaaggcttaatgtcatctaacttagtattttgaaaggataactctggcttttatattgagaatgaaatgaaagagggttggcacagaagattgaggataggaacaagggaaagaacagggagaccagttatgaatccattgaaatagttcaggccagaaatgatgatgacttggtttatgatggtagcagtagagataatgacaggtggtgggttgtgaatatattttgaagataaagataagagaatttcctaagagagcatatatatgtgaaagagtcaagtatgaatccaagatttttgttttaagcttttgagaggatagagttgccatttactgagatgggaaaaactgcagaaggaacagataagggggaaggtcaggaattcagtttttgacaaattaattttgagatatgtttagtcatcaaagtgaagtttccaaataggcagtttgtcattaaatctggggttcaaggaatcattccaggaaagatgaaatttaatgctatgggcctggattaggttacccaggaagtgagtataaacagaggagagaagagatccaaagactgaatcttggggcatttccacattaagaggcttgggagatgaaaaggaactggttaaagagcctaaaaagagagtgaacagtgaggtgaaaggaagacaaggatagaagtcaagaagaagttagggatcactggcaaacttcttctgtaaagtgccagatagtaaatattttaggcttcataggccaaaaggtctctgttggaagaatacaactctgctcttttagcaggaaaacagctatagatatcaggtaagcaaatgaacatggttatgttctgttacaactttacttaaaaatgaggcagcagacttgatttgatccataggctataatttgctgattcctgttcaagaaaccaaacaaataaactgtttccaggaggaaagaattattgattgtatcaacttctgcttatttgtcaaaggtgaaactgaggaattgaccattagatttaacagcttggtagctgtattagtccattctcacactgttataaagaaatacctgagactgggtaatttacaaagaaaaaaggtttaattggttcacagttctgcaggctgtacaggaagcatagcagcttctgcttctggggaggcctcaggaagcttataatcatggcagaaggcaagggcaaacaaggttgtcttacatggccagagcaggagcaagagagagagtggggaggagccacacacttttaaacaaccagatctcataagaactcactcactatacagtaccaagaggggatggtgctaacccattcatgagaactctgccccatgatccagtcaacttccaccaggcccgacctccaacaccgggggttacaattgaacatgagatttatgtgaggacacagatccaaaccatatcagcagcctttagtgaccttgatgagtagtttcaaaaggtgttgagaggaaaggcaaaattgaaagagggatttgggttaagagagaattaaggagagaaataagaggtaagaacaagtcagcactttgggaggccaaggcaggtggatcacaaggtcaggagttcaaggccagcctggccaacatggtgaaaccctgtctctactaaaaatacaaaaattagctgtgcatggtgatgcgtgcctgtaatcccagctactctggaggctgaggcaggagaattgctcgaaccaggacccggggggtggaggttgcagtgagccgaggtcacgccattgcactccagcctggggctacagagtgagactctgtctcaaaaaagaggtaagagaacaagtgttaaaaagtgaacgcgtttcagtttcacatttgaggggaacaaagaaatggagctgaaactgtaagtgggaaatacggtcaagagaggatgtttttaagatgggaaaataatagcgtagaatacacacaggaatgacccagaagagaggaagaaattggtgatgcaggagagagtggagctaattgctggagccatgtccttgagtaggtgagagggaatgagatctagagcacacagggtggggtccgtcatcggaacaaagactggtgatccacagtgttggtcaccaacgcaggcccatgggaagatatgttgacatgaggctagggagcaactgtttactgattacttcaattttctcagataaatgagaaacaaggtcattgactgagagtggggaaggaggtgttggaggtgtgaggaaaggggagagaataaaatagccattcagactggaggttctcaaacgttgctacatactaaaatgacctcagagagcatttaaaaattccaaaggccagattgtaaccaagacaactttactcagaattttggggtgatgccttgctttagtactttttaaagattccccaatattcaggtaaatttgagattgagtaagattactgagtcatactaggagccaacttgaatctagtgttcatgaattcaaaatgtgactagtcagattatgtgttttcctccagaagtttccatagcatgagagtgaacagtgaatgagtggagagttggtggtaaccggggtttaagatttatcaagtgggcaccagatttgagagggagcagagcaatttaaagatgtattcaaaaaagtgtttacaatacactgtagagtttatgcttgataaaaagagaagtgatgccacgaagggcataaggaatagtgaaaagccagtagaatgaatgcattggagggcctggtaatatcaaagtgttgttggaatggggtactagatggaatcatctggagacttagaaggtggaggtcagaaagtgtgatgtttataactgagtttctaacaacatctatcgtatgaccacagaaccaagtggccaaggcagggtggaggacaaggtctctggagtcaaaaagttcagtgaattactagggcaagatggtgagagaattgttttcaacagacatttaaagtaccagaagttatgacaagcatcatatgttggagagggtaacagttaggcaggagctaaaatcttcaggtagtgagggaatgataccacccatacttagatagctcctcattttcctactttcacagatactgattccatctttagacattttgaacaatgcaacaatgttaattttcttatactttgttcaatatactttcatgtgtagtcaggtactagcgttttcctttttgccccgttttattctggttattagtaattcactagtttctaaagctaattgtatcatcattgctttttacacttgaaatatccagtcactatttgtgcagagccaattcaatttttcttcttgaaagaatataactcttagctacaagaatggtccagcaatggtaatagaattattctccatggagaatacctttttgcttctctagctctcccttttaacattagccttaatctgatagcaaaatcagcagtcctaaaacaaaaggaaaaataatgatgtttctgaaaagagagagtcagaagaattaccagcacactgaatatgtatttcagtctcttgtgtaacaagtttgttgttgtgatggttgttttttgttttccctttggcaatggcaatgtattctggggaaaaaatgcagtatgttgattttttaaaaagcctattaaaaatttccaaagataaaaatgcctgaagcccttaatctaccacatgaaattgtaaatgatccccagtggtggagttctctgtgatgcaagttcatcatagttgactgatggatattttcagatcattcctgaagttgtagtgcatttgaacaatgagtattgtaggtatagtgtagaaatgttcatctttctatgactgagatggcagagccttttagctaagactcagtgtgatttattacctctatctacatcaatcaccaaacatgcaaatcatcttgactctcaggagagccatgactcattcactgatatagaatgtttctccgtcacttggctggagctctcttctctcacctccagtgttttacacagtctgtttcacaaatgtgaacaaactgatttctctgccatcccagttttctcatctcttcaaattgatggttttttccagcacatctttactgattaagctagatcatattcccactccattaaatcttactgaccattcttacctgctcatatttatatatcaagtcaaacgtctgttaacgtgtgaagtttattataatcagtctgtgttctctgtttaaattatcctacctcatttttatattaatttcttacataattcttttgtcaaacatgtataacttggagttgaaatagccttgtgtaaatcttgaatcttactccccgcaccttctgccacattgtccatttatgatgcttgtaattagtttgtagatttgactttttaagtgaaatattccagagcaagagttttctgtcaagagggagtttgcagttaggttgaggacaaatgcatatatgggtcacctggctaatttttttttattttgtacagcatatacattccttatttctagcctacttccacaaacaagtctgttaaggctcaagggtcaagtatctcaaatctgataaaatattatgcttaggtcagacacggttgctcacacctgtaatcccagcactttgggaggtcaaagcaggaggatctcttgagcgcaagagtttgagtccagtctgggcaacatagcaagatcatgtctctactaaaaattaaaaaaaattagttgggcatggtggtgcatgcctgtagtcccagctactcaggagactgaggcaggaggatcacttgagcctgggagattgagagtgccgtgaactatggttgtgccactgcactccagcctgagggacagagtgagaccctgtctcaaaaaaaaaaaaaaaaaaaaaaaaaaaaaaaaaaaaaaggaaagaaagaaagaaaagaaaaaaattctgcttagtcccatgctgtaggtagaatgactctggcttttaatggcctgccttgataagaggtcaggtgcactttctcacacatcatgccatgtccctcaaaggaggactccttattaacattgatactaaataactgataagctaatcatggagtttaacttaatacacctgaaaacgatcctaaaatgatctaaaaatctcctgggtttttttcttttcacagagaaggaaattgaaacagtcctctttcaggacccctgaaccaatattttttctattatgccatactacctctaaaataattgtttgctaatagccagctatatgcaaagaaatatattaaggcattaaaaatgtttgaagatatgatttattcctcaaggcccttaacatccctttggcaagataatgcaaactacctgtgcctctcttacacttcttagcaagatatctgtattttgtgatggtctatattgtgttttcttctcttctcctcccagccttgtcttcctgtttaccatctgaatgtggtaaaaatgcagatctacctttcttcccaatgctgaaatagggcctggctcatagttggcattcacggcagttaggagaaggactgaagagaagcctgcactttctcgtttttgtacatgctctgcacaaatcctgaagtatcctaactcaacccctaattatccccagctctttaagccctacttatctccctttaacctttgcctgcctcactgttcataccccctctcccatcgctgcttttgggtttgcatctacctcctgtccctgttttatcctattgtatttatgcatatgagtattaaaatcttaaaatataccagtaccttaaataagaactgagggataaagcagatatccctccaatttgagggtactttttttctattttattctccagaactgatcagtgccacaaaatatgatgagagagcaaggtgtctgttttctctttcagtttcattgttctaaagacaacactttcagtgtaggtgctgtgtatccattgcctgtttgaatttacagttgttttccagtggtgctgcctaactctttgctaatatctatatttgacattaggtcatctgggcagcttgctgtaatcatctgtgagaaagctcctctggaacccaccaatgggcactagaatcaaaactttggttcagtcttataatttcctcatttataatgtggggataattatagtaccttccttgtggagttcttgtgaggattaactgagtcattgaatgtaaagcacttagaatacgggaagcactcagtaaatattgttcatatggcgctcttcagtagccaaaatataacaccacactatttgcatttagtacctttctgttgtggaagcttctattcaaacaagggtatgtatttcatttatttttaacgttttgcttttgagaaagcttgagatatatttcatagttgcctacaggcaaagggagacaccaataaattgaattctgcatcctggatcataaggtaagtgccgaatctgaccacaggatcagtgcttctgccactaaacccgagtatcatcaaccttactggttctttgcttagatactcttgtccaaagttcttaaacgtatcagcaataccatcatgcatctttcttttattattatttttatttaaataaaaagcctacagcacccggtattcccaggcactctcccattcaagtactaaccaggcccaaccctgcttagcttctgagatcagatgagaccagccatgttcagagtggtatggccatagactcatgaatcattcttaactagagagcaatacattttagctaggaaaactcctgcattcaactataatttcatataatgtaaatatgttttaactatattaaataacttctccaaatatgaaacacacatatatatcatttggtctagatggatccttgactgtaatttactttgctgaagtgtccatctctctatccacatttggattatttaaattacttggagagccaaggtggctcccagactaaaatttccccaattgtccttccactgctacttgttcatgtaggaaatttctccatcctgtacacagacatcagagtactctactccaaagaggccctaggatttttatctcttcccctttcccagtccttctgacaactctccctccactgtttaaagcagtattaaaattatccaaatgttcatcattgcctctttctactttcaatattcctctagcagtgccactaatctaaagcatatgctgatttctcttccctcatgaattatgatttataatggattagcatgagcctaggaacaatgtacttcctcttgtcccagacatgtttagagctttccaatttacgctaacattggagtttgtcatgggggcatttttgcccatctatttttattatattttagtcaatactgtgttatatttccatatcatattattctgatataaacaaaaatcacaaggtaaaatacaagtattcattattttcttagtatttatcttatccactgagtagctttgactatacttaaaaaaattctcagcttatttaatagattaaaaattataatctgtaatgaattaattggaaataaccaattaatatagtgagggaatgaaagtatgtcacaaaaatctttctgaaaatgtttcaacgacataagtacaaacaactctgagaagtacaaacaactacagagaaggcataacaaatatgtcatgattgtcaatattttaaattcaccacttcaggtaggacaaaggatgttaaaatatttttctttgaatatttaatatcactaataggaccaaaaacattggaatagcatgtgtgtgacataagctcaaagttctagagcagtgctattcaatagaattttctgcagtaatggaaattttcaatatctgcactttccaatatggaagcaactagctacatgtggccattgagcaccagaaatgtggttagtgtaactgacctgatgctgaattttaaattgtctataaattttattttaattaaattataaatttaatgataaatagctacatggggctatttgtctgcaatattggatgaacagtaaaactttagagacttccaggcttctgttaagactgtaattcacacaaggctgggtcatcttgtggtcactattaggccagtgtcacactacaaagcaacacaaatcctacattaaaacaaccacataaaacgacctataagaaactaccacatcacactgaaaaataattttgatatttactgttttgcaagcgtgtcaaaatatttaaggatccttttcacacatctttctccttgaaaacctctcactatgcttcttcagtgctttcttcttgtttctcctccaaatattttccccaaacttacctatatatctcaggcatccttcctttctctcatcctcatctcttctctacaccttttaagatctgtctctttatccattatccccacacatcaacaggtccctgaccatgcacactaaacacaaaatcctcatccccagagaagagacttgctatccgtcacaagaataaatatttgtaaaggctaaattgggggctatatattagaatcatttctagatgtcacccttttttcatcctctaggcaagattatttctaatacgaatttcatgaggcctctagagtttaagaaaaaagctaatgcttattgaatgctttgagtagtaggagcacctcaaggcaataagaacatctcaaggtctcttccacctctttgatctgatgaaaaattgaataataaatataaactgggtatgatacaaaccaatgagcaaatcactttttatgtaaaagtaattaacaggggaaaagatttaaaaaggatgcccttcatcttccctagattgggagcttatcctttagactttaggttttgttcatttgggatacagtcaacaaatatttgttgagccttgactgagtgttaggcagttttaaaattattttatttgtattggtaataaaaacatggtggtccttgcccatatagagcttacaaatgttaaaggaggcagagagaaaacaagaaaatctataacctaaatataaaattatcaattgtgatcactgtaattaagaaattgatggggttgaataatagaatagcaggatgggaatgccatactaacgcatggccattagaaactaagtgatcctacataacacatgtgcacagagatgttctttatggtttcatagatttgatgttagtgtaacccatccttttacatgttatatgttgccatccttaaatggtctttggtaaaccacatctgaatttttgattagcaaatgtgaaataaagacttcagcttattccgtgtaggtgctgaataccaattaacaattcagtatgaataacatttccatctttacctaacgagcacattttttttttttttttttttgagacggagtctcgctctgtcgcccaggctggagtgcattggcgcgatctcggctcactacaagctccgcctcccgggttcacgccattctcctgcctcagcctcccgagtagctgggactacaggcgcccgccacctcgcccggctaattttttgtatttttagtagagacggggtttcactgtgttagccaggatggtctcgatctcctgaccttgtgatccgcctgcctcggcctcccagagtgctgggattacaggcgtgagccaccgcgcccggcccctaacgagcacattttttaaaaggttgtccattttatgaaaatgagtagaaatcgaaaaatgcagtgctgataatgctaagaaggatagactcatggagattattatgcatattgtattagcatcaggtggctgtaaatgcattagatataagctggtagatggtgggctacatgaggaagaaaaataaaatcaaagaagacataaaacttgctgacactacaacaacctcaaagttgtgcctaaaagatgagatttaatcgagtatttttaaaaactagatgctagatcttatggaatagaaacttgtttcctatcatgtaagtctattaaaatttttcccattaagaatttatttaaaaattcgtaactgcattatgtagaaattacatggaatatgtcttatactttgtcttttccccaaaagtgttatttcttcccattttatacctaatagagtagaggttaagtaaatggaggaacataatagaactagaaagttgcatagataggattaaaatgtagaatgttttggcttcaaagtctctgttctttctagttcatgacttctttataaaaatatatttatcagtgtttttggttggatcatcacaaaagtgggttcttccttcacttgtgtagacagaaataaagagtgaaattataacatacaagggagtaatttgaaacatgctcatttttcttgctgttgtcgaaaatgagtattttatattgttttctttttaaaacacaatttgctcccctgcacagaaaaatatacccgtttttctttagaaatttactaaatttttaatttgctaatcccaagggaaggattattttcttaggattaagtatagtcaattggtattatgatgttgggaagtaaagtgcagaattctattaaggacttagtgatttggatttgtcaaagaagagccactccgtgatgtaatttgcatggtcatatatatatgcaaagttctgtttcagcttggagactttatctttgaattttcactgagaagatattggcttattcctattttagaatctgtttagccatgactctggacacacatgtatagaaagagtaactcctttgtacatgtgcttttgaaatattgcctatgatcggtgcctccttagggaaagtgagttttttgttaagagtctgaaagtctatttaggaaagttgttttcaaagagtgtcctgaaggttacttggtctgacttaacagcaaagtcaatttaacagtagtctgccttgcagaatcctggatctatcagagattgagttctccatgctgtgtgggaaaattatactggctgattttgggagaagttactgtgggaacacattttggcacatttctgctgaagccagaaacctgaatgctttgttctttgtgaggtatcaaaaataaaaattcctgaaattctgacatcctgcctgctcccttatctgggttaaatgctgtggtaaacttctcttttggttgaaatatttaaaaaggaaagcaatacatatgaacagacacatatttatacacacacacacacatacacacacacacttgcatttctttacttgaactatcttgttgaatcctaattactaaactcacatactgcttcttcccagggaatatagaatattactgttatcaagatacgccacacctatcctcattggcgacctaccccctcaattctccttgctggtttattggattaaaatagagaagcagaaatcttatgtaggaggaatatgttgacaaatggtgggttttgtcttgataatttcaccaaatatgtgaattgactttgtcagtcattaaagtaagtgtgctgaatgccctctgtgtgtgtatcaggataagtggtctaatcaagttcaaatgttctgtgtctatttggctcagcttaattaaaattcagccctgcttttgagcaagccacagtgggttggcagaccttcaaagggctatattgcagcaaacaataaaagtgataaaggcacacaatagcaatcaatacaatgcaaatgcccctgttactcaaaaatccagtggaaagtgattgcttgaaacatgcttatccacttctcatcataaaattaaagtttttgcatcactttatttgtaagtttgcctacactctccttgtcaatgggcttgctttttttttaactacgaatggagtgaaagaaaatgatagtaagataaatcagctcaatacaaatcaaatactgtttaaatttttacagcttttgttttatttgttacacatatgggtgaaaacttactcaaaggatttttacctgtatgaggaagacagccgtaattcatcctccattcatttgtagtggaggtggtatattcttggtgatcatcctttttttttcttccagtccactgtttttggctggctgccatggtcccagattttctcacaaactgccatctggcattcttgctgtccctcacatatagctttgtcaggacctcctccaagcaggctggagaatttcacagcttgggggcatgggagtatacacgaagttgcagccacttcagggttgatttctcacctacaacccacatatctgtcactgctagatgtttagtggaaagagctgctagggcactggagattaggggacctggaaagaagtacccactcacctctgatgagctgtatttttagtcactctgtatttgaagaatagagatttttaaaacctgatctctgtattttacataatcatcgtggaacatcactgtgggtaaattattatgaaagatacttctagaaattcaagatggagatattgatattacaatatctcttatagcacacatgattgttgtatcatctcaaagttttcaatgaatgcttttatctgtaagcattcattgtaagactgaatctgtatatataattccacaatgtaactaaaatataagagaaggaaagtttcacatctcatccaagttaggtacatgaggccaccaattgcagaactctagaagtatttttgttacagtttttcaacccagtgaaacactatctcttctgtgtgtatgctttaagtttcattttggcttctaggctttaatcaagcactgagataattattataaaggtatgcttcaccattgtattaactacatcactgacttcaatagctgaaagagaggcactgggatagcgccatcacaactgttcacaaaattctggccagtggaacagctagtcacaaggccaaggttttgtgaactgtgtctatggctgtatctcagtacatctcttatcttctgcagtggaagccaatgcttctcacttcttttatatttcatccattacctacttattgcccttaaatcatcctaaactttgattgttttgttattctgttaaaaccataaatggcagaaaataaatttgaaaactaattattaacatcagtaacatgctctcttaacatgctgaagaatatcatactttcaagtgagagcagccagatcaagtgttaatttttgttttagatgccatgttaagataatagcttttagaaaagacgtacacctctattgatacactgacgcatatacaaggttcaatgaaattcctactgtagagtattgactgtgacatttatattttgtgtcaaacaattatatagattctgaatgtctacgaagcaaaattgtaaacacaactaacatcacttctttcttagataatttaatcaagatttccctgtgaacataaaatatagaatagttagtggttaatatttttgggaaatttccatcatagtataataaatatttggggaagacaaacctatacttgtaaagaataaaattttcttaaaaagtgtcatgaatatattgctcaaatttattctaatatagtttatgatagaaaaattatttctaggtagttatgttaaatagttacgaaaaatgccaatgaatgtcaggttaaacaagtttgcagtactttcaagacatggagtaatttggtaaattattgtattttaacaacagatgtattttctgatttttttttatgttctgaattttaatgtgcagaacttacactatagtaaccaagcaaaaatctcaaagggtattctttttccaaagccaaaaacaaattaaaaattagatggaccagtggcccccaggtcggcacccctactctccaattgaacagttacttcattcctaagtgcatgtgaccataatctgctttgagcattatattcaaactttatcagtctttgtttcagtctgtccaacttctgagcccaatcctccagccttcctttgagaacatatctagaataagcttaccttgtattacatctcagaagtttcttaaaactaaatcggggatagtatcattggtaagtaagctttcgttgatctggataggagatatctgcctgaaatgtgaattaatctgaaatccttagacatactaaatagttctctatttcagtgaaacagacaagtattcaccgattcttttcagtttgttatctgaagcttaagtttcctacttagttttttcctgttgctcacttttgacctataactaagaatgaggccgaagatatataccatcaggttgccaaaggagaaacaaagtaggtaggttctggggccagccactctgccagtgaccgtctgttgagatctttctatatatagagtcaaccaactgcaaatatatatgagaccaggatgtctccagtatagaatcaaaatgccagatttgagcatcctgtgtggctcacccaacaatgatggtatccatatgttagatggttttattttgtactgctttcatataaactcttcggaggcctttgaatagggatttttttcttctataattttaaatacctcaatgccaatgagatatgaaactcatagctataacttctcctacaattagggacaacaatttaaatttggaaaagtagatgactaaacaaatgtatatgaacatatacatcttcaaatataaatgctttcttaatggaggcttgctcatagaaatcagaaatgtatagtttgtttgctgttgtatcaacctgcatttgactatgattctgttctaaatgtaagtcttgtctcaatttttgaatttgttatggagtcttttaaagagacaggaacatatcaatagaagaaacagattctactgtgtgtatacttgtgtttgtgtatgagagcattcacaaaatattcatacttttaaactaactcccacagaaaaatttaaaactaaaatcacttaaaacatatgattggcaagagcttcaacaacctgagaactctatgcttatcagatgaaagaagaagcagcattatgaaaatgtatctggataccataagataatttcagagtacatcaggtgaaaacagtgagaggggctctttgttcatctgaccttatattttataaaaactcaaccttcgattccatgataaatagaatatcaaaatcccataatgtcagatatgtatctcatctttgatcttctgaaatgttatgtatgtcaagttaaaaaatcttgaactttgatggtaataataacatgcaaatattttgatcaaaactggttactttgcaaagaccgaaatgatattgaagtacttgttttttcaagagtcatatagagacataaatatatttggatagcataaaacttaggaacaaattattgttaatgagagttctgagatagaattttatatttagatttaatacttttaaaataacatttttcaaaatgcaaattgaaatattatatggatgcataccatattatgcacaggtagcgtttatttaacttttgtttcacaattatttattgaatgtctttttttgtgggagatgctatagtaggcactagtaattatgtgaataataaaatagatgcaatccctgacattgtggacttactttcgagtttggtgctataaaacttggttctctttcagtcaaatctaggttgaattattggcttcagtttttactgactgaatccatttgaatttcaataccttatgagaaagctatggcttagatagaatataaaacttggtagtcaataatggaactaggaaataaagccaagcttgcctgactctcaattcaataatttccccgttattctagattagataataaatgtataagtgtgaatttaaaactgcaaagtatgggctgggtgcggtggctcacacctgtaatcctagcactttgggaggccaaggtggtggattacctgaagtcaggagtttgagaccagcctggccaacatggtgaaaccccatctctactaaaactacaaaaattagctgggcatggtggcacatgcctgtaatcccagctacttgggatgctgaggcaggagaattgcttgagcctgggagacggaggttgcagtgagctgagatcatgccactgtactccagcctggctgacagaacgagactctgtctcaaaaaaaaaaaagaaaaaaaaaaaaaaagaagaaaaaaaaaagaaaactgccaagtatggtagaaataacaattggctttataatagctatttaattttatttaatattccttggcaattttatttatataattaaccaatattcattgagtgcctactatttggcaaacatagtttgagatcttggggatattttcaggaacaagaaaataagtcccacttctcagagtactgaagttttagcatgaaaatatagacaataaacaaatacttgagaaaatgtttagtgctaaatgctatggtaaaaagtaaatcagggaaactagatgctcaggaaatctttcccaagtggacctgaatgactaaaagagccaaccatgctaacatgtggggaagaatgtttgagaaagaaggaaaatctagtgcaaagccctgagaatggaatgaggttggtatgatcaaaggtccaagagaaatcaagtgtggctagagcactagcttttaaaatgtgattaccagatcagcaacctcatcatccaagtatttatcagtattctaggcatgttaatttccttgatttgaaaattatgctgtgattcggtaagaccttaacattcagcgaaattgcgagtaaagggtatatggcaggatttcattgtcctattttttgcaattttttgacaaatttgaaaatatttgcaaatgaaaatttaaaaaagaaatgagcaattatacagcaaaaatgaaaggttttaagcagtgcaaccagtggaatactgtgatctagtttgggttttaagaaaaatattattgctatatgatataaaaaatgggttagaagagggaatttaatgcaagcgcaatgaccggtgaaggagctgttgccattgtccagaggagacatgatggtggctggcactggggtggcggcagtagagatgagctgtgaacaagtcgatccaagataatataatttgaagatacaattggcaaggcttactgatggattgattgtgagaaagagttaacagaaatagaaaagtcaaggatgcttaggttttagaccagagccactggcttgatgctagtgatatttatttattgagaaggcaaagattgaagtaggaggttgtcaaataatggcacttgattaatttttacaagtaaattattaaaggaaatctaaacggacaatttgcattatctttgagtatttgtgattattagctggtagtgacgaatttaacttgatgaatgccatattgtctgtaaataaattaactcacttgagtgttctcatatttttcccgattttttagttgaatgcagctttagaacattaaattgtgccatatattaaataaaataattaaacaataccaacaagcactcttaatttgctcttctaaattttatatccttatgtagtttattattttattcaacaaatacttgtggagtggctactttgtaccaggtactcttttcatcactggaaatataacactgaacaaataggctgaaatctctgccctgatagagctttcattctggtacattctagaatgaggcattttaagaaaaaaaaaagtatgatatgtgggtgaaatagacagtttaaacaagaagtaaaatgactattaagccagttaataccaaggatatggaccaaattgaagccaataaggagcattgataatatgagaaaggaagggtttgggtctggagggggttttaacttaaaataaggtcatttggaaagacctctttgattaagagttaagggatggagttacaaagtgctaagaagagaggtcataaaagtgggggaataggcagatataggaagctttgtatgcttatttcaaagacgaccctgtgattgccggaatgactggaaggatggcattgccatttatcgaaatggagaagacagccgaaagagtgggtctggattgtgggcatgtttgggaggtcattttggacctgataaatttgatatgccctttagacttccaagtagagattccagtggctggtaggatctaagagatcatagatcacatgagaggcccatacctctgaatagcaaatgttgtatcaaattaagaagttatatttcagggttttttgtgtttgttgttgttgccaaggaattgatatacaggaataagttcctgataggtttaaatgcagtgaagagtgattttctcaattctcgtgagaatttggatcagaataattttatttcaatgaaaaatctgaaatatcaaatgcagcttaattgcattgacattattaaaagaatgaggacttaagcatatggcaaatttaattaaaatattactcttatagaagagtgatcatagtagaggacttttttctttcttaaagcaaattatatgccttcagcagtacttatttttacaaaatgcagaagactgtatttaagatgatttctagttcatgttattatgtggtgaaataaggaaatgcatgaagctgtgttatgttagtttgggttatcttcgaagcctttgattgggaattgactactaaacactgtaaataatatataagtactaagttctgaatgtgaatgtgatcttacatagtcatcaagccattatgtgtcctttgttttcctatcaaatgtagggggcaataatgtcagctattatatatttattttaaaaaatattttgaaaatgagaacaaggctatagatatacctataaatgtgaatatattttcaattcttcaataaaatatgttttaaaataagaaaacctgttctttttctcatcttcactaatctctttttagcaggaaagattattttttgtttgcaaataacaaggcttaggcattaagtaagcgctagggagaggaacaatagatctaccctagaacagattgaggaatcatacttaaaagacccatatattaacttggaaataagaggtagaagaaaaggaggaaaattaggagaaattactttgctagagattgttttgcattgatcatcaaatgataaaaatgtcttctttgaggttttcatttaggatctctgaactaatattcatattattgctgtagaggtattataaattcccagtcattagcataaggatttagtgacagatctgaggttctccaaaaacacctcaatgccaagcaaatgattctgctattagtcttcttaatgcacctggcaatttcctgtctttctactttgatcttctttctcttctcaggtttgcaacattaagaaaggggtagtggcaaaaagaaagaatgtcaacttagaaggctaactttgggggaaatcagtatagccgaggcatcccccaaaagcttcctttgcgttaatgcaaacttccacacaatatttaccaacttctatgaaccagaaaaggctcattcttaaaaaaaaaaaagacagctttattgagatataatttacatactatataatttacccatgcaaaatttaagatgcagtggattacaggatattcacggtgttgtgcaacctttaccaaaattaattttagaacattttcatcattccaaaaagaaaccccatgcccattagcagacagtcttcattttcctccaaatacaacccctcccttcctcagtcctgggcaactaccagtcgactttctgtctttatggatatgcttagtctggacagttaatataaatgaaatccagtcatatgtgtcctttgtgactggcttctttcatgtaatgtaatgtttttaaggttcacccatgttatggcatctatcggtacttcatttcttttgatttccacacatcgtccattatatggatttagaacattttatttatccactaatcatttgatgatcatttgggtagtttctattttgggctattacgaataatgttgccataaaattttttgtacaagtctttgtatgggcacttcttttgggtatgttcctaggaatggaattcctgggtcatatgataattctatgtttaatcttttgaggtactgccagaatgttttctaaagtggctgcactgttaacattccaaacagcagtgtattagggttctgatttctctgttgatctccaccaacaattgttattttgtgtgtgtgtgtgtgtgtgatacaatacactgaacataaaatgtaccattttacgtgtacaattaagtggccttaagtacattcacaacgttgtgcaaccatcaccattatctagttccagagctttttcacaatctgattgtagccgtcataggatgtgtgatatggtaactcattgtgattatgatttgcatttccctgattgctgataattctgagcatctttttgtgtgattattggccatttgtgtatttttaaagaaatatatattcaaatctgttgccaatttttaaactggcttttaaaattattgaattataatagtgaaaagactcattcttaagttaacaatgaatgtattacatgaaaaactcaaccaccccatggtttcagtttaaatgtattttccagggatcatggacttacccagtgcgcagataggacatctttatgacatcagaacattgatgtcaagtgcctattggttcagggtagtgtggaagaagttgtacaaaagcaggcacttttatacccttctctctgagaacattcatctctaaaaaacatacatgaaaaaactgccaaaaacctgatgcatttgtggtgtaatattaatttattggatatgaacttgttttgttgtaaactaccagagtgctttgaagaggaattttattaaatcatattcttaagaaaagtattaaatcagaaggtgcacatatggatatgcttattagtaagataactctatgttggtgatattcagtgtatagttttccagagctgaagtgagttttctgtttccacagtttaaatgaaatgtgtttcaaaatgacacttaggatatctgatggagatgttgtcccctgtcatgtttatcatttaatcttatatggcctcaaaaagagaaaatcatctttttggcatactggcatacttaatttatgcagcatactatataaatcctaaagggaggactgagccaagccagagaatggaataacctactttatttgcaaatggataaccatagacatgtccagttattattaagataaacaggaaatgatgacaaaaccaagatcttggctatgttaacaaatttcagtttctcagtctatttctgaaaatgttgagttccttccaagatcccatgttccccccacccccacaaccagatttattccaggcaatagtaaatacacctggtattcaagggaaaatattcacatattcacttttaaagccagttttgaaggagtctccaagacattgaagggaaccagatggtgtgcagaccattctacaaaggtttatgattagtttggctaaagcagctggtctctgcaatgaaagagttgtcatggcagaaaaatccccttttccctcagtgcagctgggcttgtccagggacgacttttcccaggcaagtgttctctctccattgggtgtttgcaaagtctgttgtacttagagaagttaaaccatttctgttgaaccaagttgacaaaaaacacaaataagccaatgttatttatttattttttttagctcaggatggtttaattgccttaaaaaaaaaagttttcacctctgagtgggccttttctgtccagtattagaaataacaactgagactattcaggaaaaaaaaaatggcactcttccaaaagagaaagtgaacttcaacacaattctcagattcaaaaggactgcaaaggaggattatttctgccagctttggtcatttgacagctacaattctccttcttcaatatgtcatcacaaatctctctcaacatattaatgggaatcctgcatttaattctttcatgtttatggagagggaggtggggtggagagggagactgagagagaactttcaccttctatatgtgataatatgtttaaatgtaattaactgttctgcttttgccgttaaaatgttattttgcattcccatcgtattgattttaaattgaaactcaatgcttttgcaaagacagtcttggggttataaaatgataggttttattgcaaagagaggaatatttatctgaacagatacatgagtgtttccataaagaatgggcctattttactttatcagcaactaaggggaaggttaatggctatgatgtatcttttctgttgtgtgtgaaacatgcagtgttcttgctgttgagatttatggtgtggaggacaaagcaggtgctattccaagccttctttcaacagcggagtataaactagggcctgaacttatctgtcaaaaagtaagttaaaataacgttagagaaagcctagaatttcacacttttccataccttcctgtctctagctcaggaatttaggcagggtgattaatgaccactgttatttgtgagctttccaagtccctacagacataatgaacttgacttttcagccacgtagaaggaaacaggctgttagagctctacaacatgacatgttcataattatgagctctctgcaattgggaagaaagaggaagaaaagagaataatcttctcatgtcccatagtctcaacttcaaacatcctctactccctctctttcttctttccccatcttcttcccgcctacacacacactcacacacacagaatgtatctatacttttattaatccagaaacaaagtctgactctacttaatcttgcctcttatttttccttcatatcaagcaagcaaatcatgcttactgatttctttgtcagaatatcgtatggatttgtccttccctctgttctattcaccctgtcgtcttgtgtttatgctagcccaatccctgagttaatttaggctccaggcactgtatgctttttgaggtaatacaacctcttcattttcctgtgtcttttattttaaccccagcagtttattttcttgcttttcaaaatcttttttattctgaccccacctccaaagattgtatatgctccctctttttgttatcgctaatgtaaatatctcttatccttttgaagttcaacattcatttccatcaagatgtactttaaatgcatcttcttgtataatccttttcagaccagcttcacctggtaaggtccattctgataaactgcttacaatgtttttaccccgtaatactaatcatatcttagactacttacttaaataaaatacaacttcttgcgcataggtatttgttctaaggatagttgctttgttatctatatagtcagtattcaatgccttttcaaatataattcaacaaggcctgttttcaacctcaaagaagtgaatgaagagtcactaactttaaagttccagcaatcccacagcattccccggctcctccagagtacctgtggaaattagattccttgtaagccactggtaattttaagagtctgctgctcttaaggaaagagtctgctgcttgctacaagatagcagaaattagtgtgttggttagttctgatcctgaaaaccttgcctttatcaaagacagaacatttcctgaatctcccgatgatatagtaaagtagtggggagaaattaatctccatcctccgccaatgtttttaccggatactgcatggcatccttcctattatggagtgttattttgactagaaaaaggattaggtggcaccatgggagaaaggcatagtctggttgaagcttatacgaattttcatttacatcctttctttttgtcttgcaaattactattctttttctctctcatttccaccctagaagtcccttagatgctctctttattctccattgctctctgatgctcttttattgaattctatgctccttgaatacaggtcttatgtcttgtttacctttgtattattacagttatctctgtgccttccacacaacaggtaatcaataacaatttgcttaatggaattgagtaattttagaagactagtctatattatagactctgataatttccttttattctacaaaaaagattttctatcccaatttttcttaccagtatcataccactcacaatacagcatgctgctattccatcagcccagagaatgtgtatgaacacagctactcaggtattccttatttttttcttttgaactaatcttaaagacactgattatatctctcttatgaagagcaattatacaattttgtggtagttctctttttacaagtttatcttcttagagaagtataactcttttttttttttttccaaaaaggagactatttctcagtatcctggggacatagcatgatgtgtgataaatagttattgctcttttttttttttcagagtgtgatcttcaggtgatcttttcatgctttttccatcctttcttcatattgtctttgacttgtcatagtttctgcctggcacagtgcctcctaaattcatctattactctcacctttctttccacttttctcatgtgagaaatacacatttatcttcatttaccctggaaggttttctccttaacaacagtgtcacacatgacatactatacattgcatgctctacaaaataaaacataacctatgagagaacaaattcataagttttattgtaatcaaaatatttttttgaaaaatcttacatacagtattaatttttcagttttctctgatacaaaagacaccctcacttaatgagaaaaaaagtcttagaatacgagagctggaaagtgtctttgggagattacttggcacataaatatgatgcatagaaggtaggaaattactgcataattacacaagtaatcagtgacacagtgtctagatagcccaagtcttctagtataattataaggccacatatccgtcatggtgactcatgtctttattcacactgaccctgtttttaattgtgtggattttcacagaggaaaaaaaatggtggtctttgtagagctggaatgagtgaatactttctggtagatacattcatttttcacatttaaatataatcttagtggattttagtttttactaaactacttaggaaaataaggttaaataagtatattttttaaagatttgaccttctaaaagttcatttaaaagaaagaaaaaatattttaattgatggaaaatgagcaaatttattcaaagtgacattagttgcaaattcattctgagatcatcagatattaaagcaatgcatttagaaacgttattcttcatattaccaaactgaagcaatttaaatgtctatcaatagtagaatggataagaaattgtggtaaattcacacaatgaagaactttttttttttttttttttaacggagtctggcttcgttgcccaggctggagtgcagtggtgtgatctcagctcactgcaacctcccccgccgagttcaagcaattctcctgcctcagcctcccgagtagctgggattacaggtgcatgccactatgtccggctaatttttttttgtatctttttagtagaaacggggtttcaccatgttggccatgctgctctcgaactcctgaccttgtgatctgcccaccttagcctcccaaagtgttggtattacaggcatgagccaccatgccaggccccaagaactattttatcatgaaaatgatagaacaaaactacatgctataacatggatgaagcttataatcataatcaaaagaagttagacccaaaggaatacttattatataaatctatttttataaagttataaagttcaaatctgtgagattagaaatcaaggtggtaattactgctggaaggagggaaggccagtgttttggatgaggcaggaaaggtgcttctaagtactggtaatatttcttgacctattgatggttacacaggcctgttcatgttgtgataattcagtaagcttgggatttatatacttttctatatgtatgtttttttaaagccaaaattaaaaaaaaaaagactaaaggggaaatttattgaataccattagcttttaaaatgtatttttgtttttacttaagagttttaaaaagtagtcatattttaaatttacatattgttgggaaaattctgccaatggtaggataaaacaatagatttcaattgaaatattgaaagcaacttgtgttggtaaaagatgagaagtgaaggtggaagactgattaaaactaccaaaaatatcatagtgataacacttttatttttctttttttgtgggggtggggatagtaccattataaaaatacaaacataagctgcttttgtacatcaccaaataattcattgaaatttaaggaaatcaaccagttatgtgtgtacacacacacacacacacacacacacgatctcatagagtgaagggttaattggaatactgactgagtgcaatgtacaagaaaatgtacacactgaatacaaacaagggaaaaaaatcaactttgcctaggagaataataaatataattataggaaggaggggggacagggtaggtgttaaaaaggagtttcctgggaaaataaggaagtgaagaaaggcattccaggcataaaatatgcttgctatgtgcaaaacaacagtgggaaatagcatagactcttccatgtacatactgcaagtgggtatgtgatggtggagctacagttggaaaggtaggtaggggtcgtatcatctagcccgatttactagagtttaactttatttactcatgaataggtagatcttgacagattttaatgaggggagggacatcaggtgccaagtacctacaaacatttaaacaagggaagggttttatggttgcagtgattaggacacgtttgaggaatatttagacaattaagttagtggaacttatatttttataggatgtaaatgaaggggcacagggaagccaccgaaggtgatttctgagattctgttttgcataacttggtacatgatatgccacagacataaaggggaaatgctttcaaagagatctgtgtttttctcaaattttacccaatatatttgcataaagctcaatgtagattggaactatggcaatttgattcagttccacagcttaagtaagtgttattttgttcagttaattgaaaatgaaactatacctgacaggaagctgattacttatatgctaatgtgacagtattatagatcataggacttataacacctattaatttggtaaatgggaaaaacaaaactgtatactgtgaaataagaatttacgttatgtatataagaaatagttgatttaggctgggtgtggtggctcacacctgtaatcccagcactttgggcagccaaggcagctggatcacctgaagtcaggagtttgagaccaacccggccaacatggcagaaccccgtctctactaaaactacaaaaattagccagatgtggtggtgtgtacctgtcgtcccagctacttgggaaactgaggcaggagaatcacttgaacccaggaggcagaggttgcagtaagcccaaatcgcaccactacattccagcactatactccagcctaggccacagagtgagactgtctagaaaaaaaaaagatgaagatacagttgatttaataaatggttatgatgaatgcatattatcatacttgcaagtaaaaatgcatatgcttataaaatatttttgaacagatattttaaaatcatagcaggttttagaaatcaaatttatggaaaacgtactagtttcatgtgtatactctaacaaagtagaaagagacaaaaatgtagtttgagatcctctgcaaatgccaaaatttagccagagtaggtaaaggacttgacagatgaaatgcactctgtctcttacactgagtttatacggagaaaagtaattttcgtaggcagtgaacacataaggaaactggtccaagtcttatgaatgtgaacattagtagaaaataagttatctttgagtatttagtagaaacaccaggaatactgcatagagggaagaaataatccaggaggtactactaataaacacatttttaattttagttcacatatttgggagaattcttacaaatttcatcggctatataccaaacctgaagaaaatattcctaatcaaattctgtggtaagccaggcacagtgtctcacacctgtaatcccagtgctttgggaggctgaggtggaaggaccacttgagccccggagtttgaggctgttttgaggcttgattgtgccactgccctccagctgggtgacagagtgagaccctgtctcaaaaattaaaaagtaaaacaaatcctgtggtggccactcctcatgatagtgacaggtacagacagtcttgttaatctgtggaaacactgaagtgagccaaatcatgttgtttaatggttcccatttggcattttgagcttgtttaagggtatagcaaatagagctataaatagtgcattgaactatgaattaatatggtctgtctgaaatcaatggaattttcaagccctttctgttaatatagagaaaaccaacttaaaaattatgactagcatgcagttaagaaacttggcaggccaaacatcttagaactaattaaacaaaagtgatacatttactcacatgatctactaattcattattattggtacgttagatgtttttcaaaaaaatactgttgtaaaaatttccctcaggtttgacaatgataaggagtgttgtgaaactactgtgattaaagcaccaaaggtacaatgggtcattttatatatacagcattccgttaagtgaagttgaatgcataatgactatattagcatagaatatatgagattagaattaggttttttttcctctgatttgaaattattggaaatcaaatagtgacaagaatgagtatattttccttcaaggcccttgaaaaacaagtcttctgtgtcacgttttatcggttcttttaaaaagagtaaacttttagcagcaagaaagatgtttgaacattattcgagtagctgccacttttaaaacctattgactagggaaaaatgaccccaatttttccccattatggtttgtctgtgtttgcgagtaaagacgtgtcttaattaaaatgttttaaatatgtacctaaaattaatatgagaaagtcataataaaaggccagatactctttagcatggttcttaaccatcaaactttcacttctggttctaaaattatacacctagaataaaatgaacatgtaaaaatattcatgtgtcttgacattggccttctgataaatctaatttgctaatataaaatcttgtaaaaagactataatctaccaaatgaatttactacaatatactcttctaaatagatcttacttataaacatatatgtgcaaaaagagagagaaaaggtttaatttatagtcttaaaaccaatatgctggctatcttagtgtatctccccagatctacatccaccttccagaacatgctctatgccatgggagggggatctgtaaagaatgcatcaatgggcttcctgtcctcctgccagctgggtgtggccagtgaggaacaccagaaaattaatgaaagggggagaattgggtggaggggtctttgttcttcttgttacatttttgtaagtgattcttgaggtgaactggagaacagatttaccacaccttcatcccagcactttgggaggctgaggcgggcgatcacctgaggtcaggagttcgagaccagcctggccaacatggtaaaaccctgtctctgctaaacatacaaaaattagccgggcatggtggcaggtgcctgtaatcccagctacttgggaggctgaggcaggagaatcacctgaacctgtaagagagaggttgcagtgagctgagatggcgccattgcactccaacatgggcaacaagagcaaaacgccgtctggaaaaaaaaaaaaaaaatcccacacctcctgtcagaaagccctctttatccatcttgccctcaatctctgggttctggtatccgttccatcctttagctttgtcttgcccacatttgtgtgtgtttatatatatgtgtgtgtgtgtgtgtgtgtgtgtgtgtgtgtgtgtgtgtgtgtgttattaaatattcctcaaatttcccaactcaagtatgctgtttgtttcctggaaacaggaagatatctagaatctacttctaactggctttgaaaatctggcagtgacagctgggggctcaattttgtatactttaaactttaaatttatatcatttatatatttataaaatgcatatattcattcattgttaatagtaataaaatatatagcaagcatttgggaggcagttttaaaagaaggccattaattttgctgctttagaaaatgttttatgtaaggtgtttcaaaatttggaatttgactctgcatgtagcaattggtatgtgttttactaaagaattatactctacctgtaaaagttcttttaggtaaagacctggaaattatattcaacatttgtgaattgtacactctttaatgcagtcaggattacaggcaaattttctagtagagtaaaaatatacatgaattgtaaaagtaataagaaaggaaatttgaattttgctatagttgttagagagaaggagttagatgatttttattcctgttgccagtaatactaagataaaatgattagagtcacatacacgttatatatgaaaacttataggaggtatgaagaccagaattgtttaggagtttataatctgaggacttatatgatgttctttaacattttttatgctgagaaagaatattattaaacaatgagttaagtcagaacataatgtgacagttaaatgtctgttaaaaaatacatttttgaaggcagaacttctggttatggtagaatatagagatcagcaaaccctttccccaaaaaagtaaaaataaagctggataacattgataaaaccatgagttcagttttttggaaattggccagaatcataaagtaatctggagagatttcatggctttgtagtataaattacaattattctaaaatatttaatctgaaggctatcatgagattttaaaatggaggggacatgctaagtaaaaaatgacaacaggtgattaagcaaaagtgaaaaatattaattttagtatatgattccagcaagtatgtttggactgttgaactattatgaatatttacctatcattatcatcttttaaaatgtctactcactagaacatctcactaattatgtatttctttatttctccccaatagttgtgctttgatagtttttgcaaatttatttaatcatactttatttgaatgtattacattcatattttattttttaacgcagacatttgatatattcagaatggtagaaaattaaatgtacttttttagtattattattatttgagacagcttctcactctgttgcccaggcggaagtgctgtggcacaatctcagctcactacaatctctcccttctgggttcaagcgagtctcctgcctcagcctcctgagtagctgagattacaggtgtgcagcaccaggcccggataattttttttttttttttattgagacggagtctcactctatcgcccaggctggagtgcagtggcgtgatctcggctcactgcaagctccgcctcccgggttcacaccattctcctgcctcagcctcccgagtagggtagctgggactacaggcgcccgccaccacgcttggctatttttttgtatttttagtagagatggagtttcaccgtgtgttagccaagatggtctcgatctcctgacctcgtgatctgcccgcctcggcctcccaaagtgttgggattacaggcgtgagccaccgcgcgtggcccgggccagataatttttgtacctttattttttgaatttgttaattagcttgatttaatcattttataacataaacatatatcataatattacattgtacccaacaaatacataaaattatttttcaattaaaagtacagttttttaaaatgtcaatttttctttttcaatgattcttttatttattcactttatttttttcagctcttgttttagattcatgtgtacatgtgcaggttttttacctgggtatattgtatgatgctgcagcttggagtaagaatgatctcatcactcaggtactgagcattgtacccaatagttagtttcaacccttacttcccttcctccctccccccacaatagtccccagtttctattctttccatctttatgctcatgagtacctaatgtttagctcccacttaaaagtgagaacatgctgtttttggctttctgttcctgcattagtttgcttaggataatggcttccagctgcatccatgttgctgcaatggtcatgatttcatactacatagccacaaaaaagaatgaaatcatgtcctctgcagcaacgtagatgtggctggaagccattagccaaagcaaactaatgcaggaacaaaaaagcaaataccgcatgttctcacttgtaagtggttgctaaacattgggtacacatagacaaaaagatgggaacaataaacacgagctccttcttgagggggtagggtggtaggaggatgagagtaaaaaacctgtctattgggtactatgctcactacctaggtgataaaatcatttgtacaccaaatcccagtggcacacaatttactcatgtaacaaacctgcacatgtaccccatgaaccaaaagtaaaagttggaaaaaaaagaaattacctatacataaagtttgaggtcttacatttaaatctctaatccatcttgagttaattttcatatatggtgaaagctaagggtccagtttctttcttttgcatatggttggccagctgtcccaacaccattggttgaatgggggtcctttctcttttatttatgccgactttgttgatgatcagattgctgtaggcatgtgactttatttctgagttttctattctgttccattggtctgtgtgtctctttttgtaccagtaccgtgctgttttgattactgtagccttgtagtatggtttcaaatcaggtaaagtgatgtgtctggctttgttctttttccttagttttgctttggctattcaggctctttttggttccatataaattctggaatagttttttctcattcagtgaaaagtgacattgttcatttgataggaatagcattgaatctatacattgctttgggcagtatggccattttaacaatattgattcttccaatccatgagtatgggatgtttttccatttgtttgtatcatctatgatattttacagcagtgttttgtagttctccttgtaaagatattttacctccttggttagatgtattcttaggtatttttatttatgtgtagctatagtaaatgggattgcattcttgatttggctctcagtttgaatgatattggtgtatagaaatgctacaaatttttgtacattgcttttgtatactgaagctttactgaagtcatttatcagtttcaggggccttttggcagagtcttctaggtagaggaccatatcatcagtgaaagagacagtttgacttcttcttttcctatttgaatgcctttattttgatctcttgccttgttgctctggctagcacttccagtactatgctgaacaggtgtggtaggagtgggcatccttgtcttgttctagttctcaaggcaaatggttccagcttttgacagtttagtatgatgttgactgtaggtttgtcatagatgtctcattattttgaagtatgttcctttgatgcctggtttccggagggtttttatcatgaagggatgttgaatttcatcgaaagctttttccatgtctcttgagatgatcatatggctttggtttttaattctgcttatacattcatatttttaaagtcacaaacatatagagttgcagttattaacatgatctctaatttttgtaaataaaattcaaatatcgattttagtgattgatgtaatctctaaataagatctaatgtgtattcaaaaaataaataaataatttgcaagtatttagtaatgtgtagatggtggaggggagtgtcatattgtaattaagagctgatcccttgggcttaaactgccagatcatgccaaagactggctttgtcacttattagttttgtgactatgggaaacttacttgtctcctcagcttcttcaccttttagattgattcagttttagaacctacttacatagggttgttgtaggtacttctatgatataatacatattaccaacttagaatacaagcagacacatggtaagcactcaaaaattgttagttgttcttatttttatattttccttcattataagctgttacttgtgagagggaagaaaaaaatctacttttatcattgtttagaatagtcaacttatgttccagttcttataaaatgacctcaccatatatcgtatatattgcacagtgaaaagatgcttctgtcttaataaatatacagatagcccatagggaccaactctttgtgcggatataaaatagtacagccacaatagaaaacagtctcttaaggcagttcctggaaaagttaaaaatgaacttaccatataacttagccattcaagacctatgtattgacccaagagaaacgaaagcatatgtctatccagagttgtacatgaatgaacatagcagctttgttcttaatagataaaaactagaagcaacccaaatatttatggaggtgaattgatgttttaaatggtggtttaactatagaatggaatataactcagtaataaaaaggaattaactattgttagcctgcgacagcatgtatgaatctcatgctgagtgaaagaagccaaaccaaaagagaatgcacattgtgtgattccatgtgtatgaaattctagaaactgcaaactaatctgtagtgacaaacaacagatcggtggttgcctaaagacagtgaaggtaaagtttgaagagacagattactaaggagcatgaggaaacttttaggtgtgatggatatattccttattttgattgtagcgatgatttcctgggtgtatacataagctaaaacttataaaattctacctattaaatatgtgtggcatttacatttgtatgtcaattataagtctacaaagctatttttaaaaatacatttctctcataaactaaataaatgcagaaatttaacattttggatgttgtattattgcatgttttaaataatgaattcaattggagttttctcattaaaatctaaagttgagtttaggttcacagtcaaatgatgtcctataatctataaaagttattattgcacagtgataaattggaaaccagagagaccgacattatataatatttcagttgagtgtgatgtgtctgttatgtacagattttggcaccacagtgcatggaaatatatacaaagagtcttcaaaaagttcatggaaaatgcatattatggaaaagcagttcagagaaatcaaattttgttgaaccaaaataaactcatactaacatttaaaaacacgtctagatagcatctagtttgaggtactaagatggataagtcatcagtttaaaaagaggccctggcggggtgaggtggctcacgcctgtaatcccagcactttgggaggctgaggcgggtagatcgcctgaggtcaggagttcaagaccagcctggccaacatagtgaaaccctgactctactaaaaatacaaaaaattagctgggcatggtggcggccatctgtaatcccagttactagagaggctgaggcaggagaatcacttgaacccaggaggcagaggttgcagtgagccgagatcatgccattgaactccagcctgggcaacaagagcgaagctgtgtctcaaaaaaaaatcagatttatggtgatgcttgagaggaagaatggtgaaattattgatgttttgcacaacatttatggggacaataccccaaagaaatcaacagtttacaaatggaaaactcattttgagaagggatgagacaatggagaagatgatgctcgctgcagcagactgtccacacagagcagaaaattaatcttttttatgccctgattcaagaggactgaccattcacagcagaaacaatagtgaacaccatagacatctcaattgcttcagcttacacaattctgactgaaaaattaaggttgagcaaactttccacttgataggtgccaaaaccattgaacccagattagtggagacaagagaagagctttcaatggaaaatttaaacaagtgggaccaagatcttaaagcatttcattaaagaattgtaacaggaaatgacatacaactttaacagtatgatcctgcagacttagcacaatcaaagcaaaggctaccaagagctgaaactggtcctgtcaaagcaaaagcatatgaaacaaacatgtgagaaaagttcaacatcactgatcattagagaaatgcaaatcaaaaccacaatgagataccatctcacaccagtcaggatggctattattaaaaagttaaaaaaaaaaaaaacaatagatgctagcaaggttatggaaaaaaaggaatgcttttacactgttggtgaaagtgtaaattagttcaaccactatggaagacagtgttgagaatcctcaaagacctagaggaagaaatgccatttaaccaagcaattgcattactgggtatatatccaaaagaatataaatcatcctgttataaagacacatgcctgtgtatattcattgcagcgctattcaccatagcaaagacatggaatcaatataaatgcccatcagtgatagactggataaagaaaatatggtacatatacaccatggaatactatgcagccatgaaaaggaatgagatcatgtcctttgctgggacatagagttggaaaccattatcctcagcaaactaatgcaggagcagaaaaccaaacaccacacgttcttacttgtaagtgggagctgaatgatgagaacacatggacacatggtggggaacgacacacactagggcctgttggaggtggatggtgggggagggagagcatcaagaagaatagctaatggatactgggcttaatacctaggtgatgggatgatctgtgcagcaaaccaccatggcacacagtttacctatgtaacaaacctgcacatcctgcacatgtacccctgaacttaaaagttgaaggaaaaaaaaaagcaaaagcagattagtcgagagaaaaggtcatagcaacaatttttgggtatgctcaaggcattttgcttgttaactttctggagggccaaagaacaataacagctgcttattatgagagtgtttaaagaaatttagctaaagctttaacagaaaaacatccagaaaacctgcaccagagaggccttttccaccacaacaatgctcctgctcattcctcacatcaaacaagggtaattttgtagatgtagaagttttgatggaaaatcattaggtatgcgccttacagtcctgcttcggcctcttcttactttttttgttttctaatcttaaaaagtctttaaagagtattcattggcctggttaaattccgagcatcttcagttttttaggagtaaactaaatggtatcattgtttacaaaaatgtcttaaacctattttgaaaaataaaatttatatttttaaatttttatcttttatttctatttttctaactttttgaagtcccctagggtgtgtgtgtgcacacatgtatatttgtgtatatatactcttaacccccacatgtacatccatgctgcatcctattgggggaggcagtttgtgaaagcattatccaagaatggtttagttgcccttgattttatatatagtgatccagtcataaaactgtagtttatgtgtataattacaggaagacaattcatttgaagagaggcatatgcacacagttatttcaagaagccattttttatttatgaattttcaggtcaaattttttaataacctaagcaacctttggtaggatgttttaacagaattctaaatattctatattgtagtcccccaaacagtgaaattttcaggaatgtaatactttgtcattatgttagctcatctatgtaaaataggctacatttattccaaaacgagaatactttgaaacttctaatgcttagatatttaaatgtggtgattatgctctcatgaatatttaaatctttggagtcagacatagttgctgctagtgccaatcaaatctaggatgaccaaagaaacactgctttcatgaataagtaatctttctccccatgagttttctgaatagtctaagaactcatgtgggaatagggagagcactgttagaatgacattttatctaaaaaagggagcaaccacgggagcagatgtagtatattataatctgcttgacctgttcacaatgatttgtgagttctgaactctaaaggaaatgctttgtttgattctaaactatagctaacaatgttggatcagtgtatgaataactgaagtatttattattctcaggaagtacatattggtcatccaatatgaattctaaaataatttaatgattgctattattttaactctataatggtaataataataatcttcctacatttcaaaggtcagctttacattaaaactttcgctctgaaatttcatattggccatattactctgtttaaaaacattttctaaatatcacagtgaattatatagaattctgtttaaaatttgaattatacagatactatattgatggtagatgccatgagtaagttgaaatatatattattagaagaatatgtcacaacagaataattaaaagtgagtactaagaaataccttatattagacttaagcctccctggataccaaaaaccttagtgtctatttggggaattcctgagatttcaacatagagcattagccagtgtatttgcaaggccactcaaattcactctcatagaaaggacaagaaatattttattcagaaagaagttcatctcggtaactcaagccaagtgaatcaaaagtctaatgttctttgggggcaaaatttctctattgtactcagaaaaaaaaagtcaaggtagtaattgttactgtctaaagaaagtcattgaaataacaggacattctgaagtttgtacttttacaattccttaactttatacatgcttaattaaaagttaataaatatttaccaaacaccttgtttgtgtgctggggaaagaggtatacatatatgtgtacaacagttcttcatttctcaagcattttttagtgggtagagaaagtggtcattagacatatacagaactgataataatacacagtagattgtgataagtgctaatatcatttaatattcattagtttaataaatacagctcagttctgttgctaggaagatcaaaatggctaatgcatggtctctggtctcaaactcacagagtagtgtgggaggtaagcagatacaatacagaatgataaagcctgcactagaaggttcacatgaaacatagaggcagacgcatctcattctctttgtgaaaaggtggcaagtcctgaagaacttctagtggctttggctaatatatagcttatagttacaaagtaagcagtatgacacagggaataatttaatatgtgaggcattattacatagttcctctttcaaggaaacatagctgtttagtccaatgggatcatatgggcaaaaatatcataaattaatatatataatcttcttaaaattccatatgttactctagaacagcctttgtaagccctttacagtaattaagaattttaaaccttattgtaaatatagtagatttgaactctaggcagcataagaagttttatatgtatattcatacagaaaaggaacaaaatgtacattgtgaatgattggttctttcggcataccaatgtgtcacttactgtggatattttcatgccagatattcagaaaagtttgtgtgtgtgtaggtttctatagtatcagtatagtaattctgtaatatagttcaaattataagtatatttttatataatttactgtgatatttaaacttttttaatatttaggatatacaagttcagatttcttacatgcatatattgtgcagtggtgaagtccacgcagagtaaaacatatatacacatggacataaacagatatatatgtatttacaataggtccacaagttatattttcctagagtaatatgttcattttacaggaaccaataataaataggaaaacaagcaaaagtactacattatacttttctttaaaaattgagattgtagattacatttaatagtaaaccaataactcactttttcctttattctgaacattggtatcagaaaagtatgacttctgtaacactgactagattatatgattcgacgtgaatctgttagaagcaaagagaatgatgaaaaagctataatatttagttacacatggtcattttaagaagagaaaaagcatggaaggaacattctgattgactggtgaaccactaccacgtattacgtgttgcctcaatgaattaaccgagagtggatttgtgtgctcacaatctgcttctgtagaataagaatgaacgtggagtctttacctgcttatagtaagcgtttatctctcaaaaacctttaatcatctgaatatcactaatgcaaaaacaggacccaggtaaatcggagaaaatagttcattctttgagcctttaggaaccagaaatttctgtagcaacaagagactttcttttataaggttttaatacctctgatttatttttcattgcaacagaggtttacaaagccacgcttggaggctttgtcaggattttgtagagtgtcagcatagtcatggtggatgttgcagttgcactgaaggtaccttaactttatgcaggaaaagaaacttaagtgtaactaaaaagctaaattttaaagtgaatcttaatctatgtggtaaggacaaccaccactacattcatagaatggacagaattgatgtttgaagaaatttagtactcacagaaatttggagtttttctgacataatatttgtaagatctgtacctatcatcatggcaaggatagcgagtatgtagctcattttaaaaatagttgatatacatttaaaatattttagattcccctttcttctaaatatattgctgttgattgttcaggttagtaatttgccttgactgtcactgtttttcagtttctctattaaaaattgtctgaatctatgtggatatatcatttattattgattgttccataataaaagaatctcgatttgtaggatcatggaaataactgaatttgaagcatttataatttacctggttctccatatccaattcatgattatcacctttgtattgatattttctgatgaaaacaaattcactgtgtgccaatttctacatttccactctcattgttttactcttttgctctagcaattgatctatgtcttttgtttcattgcctcacagactaaaccagtctctagtattaactccagtaatatttaaggtccttcaattaatcattccttaatgggtttacatattaattaatctgttgatgtattcatgcatgcatttgcaaatataatttgaagccctaccattttctaggaattctgcgagaacctagggaatagataggactacattgattttgtcatcatgggattctggaaacattcaggaggagcatctcatctctagcctagggtgtcagaaagaacttgagtaatcaaggattgggtcttaaaggacaagtgaacatgtgcaggtgagaacattctaaaatgaagggacttgaacaaaagcaaagccatgttaaacagcttgtacttcatctgtaggtagatcagtaaccactcaggggttttaatcagggaaatgatcttctcagatttggcttcatatgaatctctctatttgccttatgtcacagcatatattaggagatcatcagagtagtccagacaagcaggaatgaagataagcatttggaatctagaaatgattacattaaaacaggcctagacacaaaccaccacattttttgccagaaaggcatagaaacaaattgtattagtgcttgccaggttctgggaggagttggagatggagaatgactgctaatgggtataagatttctgtatagtctgttctcatgctgctatatggacatacccgagattgggtaatttctaaaggaaagcagtataactgacctcaggaaacttacaatcatggcagaagggacagcaaacacgtctttcctcacaagacagtaagagagagaagattgagtgcccagtgaaggggcaagctcctcataaaaccatcagatctcgtgacacctaactcactatcacaagaacaggatgagggaaaccacatccatgattcaattatctccaacggatccctcccatgacccgtggggattatggggactacaattcaagatgagatttgggtggggacatagccaatccacatcaatttctttttggaatgatgaaaatgttctggaattagatagtggtgagggttgcacaacattttgaatatattccaaattaataaatggttcacattttgaatatattcaaaattaataaatggttcactttcaaagggcaaattttatggtgtgtgagttatatctcaagaaaactgttattaaaaaaagaacactgcatttagtgatgaacgaacaatagagcgagatggaggtacctaagaaaactcccaaggttcttgctttggtgactgggtagatgactgtgttatcaacaagatggagatcaccaaaaaaggagacattgtggggtgacaatggggataaaattgaggtagttggtgttgatttatttttaattgtgtttaaggtctgtataacatccaattgtacttgaactggtgtttggtctacgccatagatacaaatctggtaaatcttatcccagaaagtgaatggctccccaaatttttctgcctttacatattccagaagtacaacataatcttattaatagcatctccctttgcatgccagtgattctcattcaaggagtggagcatgtcagaatctgccatgtacaagactgtagttcaaaaaggccagcttatcagagatgctgacatattccatagggaatttttgtcaaatctttctatatcctccattggaaattattgatatacatgatggctaaatccatgagttcaggtgtcatcacctacagctttatgtcaagtgaggagaacgttgaagggctcaaagaagtaaaagcagtatttgaaagctcacataaagaacgaacgaatgaataacaactgcaggaaagattcttggcagataatagtttcaaaattagtatttattgagcaaatgcattaataagtgaatgagtgtgttttccagaaaccgaagaatttcaagaataataaactattttaaaatcaagatatgaatctaataagacaaaaacaggtatgtccattgtacagttatgctctgcatgatgttttggtaaatgacagaccaaatttaccctggtggtcccataagattctaatactgtatttttaccatattttttctatgtttagctatgtttacatatacaaatacttaccattgtgttacagttgcctacagtattcagtacagtgatatgctgtacaagtttgtggcttaagagcaataggctatctcacagagcctaggtatgtagtaggctatgccctgtcgcattgtgtaagtattctctgtgatattcacatgacgatgaaatcacctaacgatgcttttctcagagcatatcctcatcgttcagtgatgcattactgtatttggtgaccatagtaggttgactatagtagtacagggatgactaggaaagtaggaggaggagatgagaaggcgatgggtatgaactatgctcttaagaaatgtggataaaggagagggactgagaacataggagggctctagaggaaagaagatagatttaatgctacttttcgcatataaagtcattcttctcctaaataaaagtttctatgattttgttcaggaatcatatttaaccagttttcaattttcctatgaaaccagaattaaactgcacctaatttctgatcattttctttcttaatttgtgtaatttagaaataggtatgacgggccaggtgcggtggctcacgcctgtaatcccagcactttgggaggccgaggcaggcggatcacgaggtcaggagatcgagaccatcctggccaacatggtgaaaccctatctctactgaaaatgcaaaaattagctgggcgtggtggcacacacctgtagtcccaggctgaggcaggagaatcacttgaacccgggaggtggagtttgcaataagccgagatggcgccactgcactccagcctggcaacagagcaagactccgtctcaaggaaaaaaaaaaaaaaaaaaaaaaaaagaacaaagaaataggtatgacatcatcccttcaaaatgtcatctttctccacattccatcttacccatttataggaggttaaattcatgtgtcattttttagtagaatttactgataaaagctggccctttagtggtatcaggtctgtgactgatatgtcacaagttgatgatgactttcccattgttaataattctacagctgtctatcttattcatcctggtccttattcttggtacagctcttctttaaatcacagaagtaaaagttccatatgtatttattataaaagatatgcatatggatactttaaaacgttttattgttccctgtttaagcacagtaatttctactagaatttttgtcatagaaagataaatcttctccctttgctactttctgctttcatcttctttgattcttccttggatcctgcccttttctccgttattttaaatttttaatctgctatttattcactgtcttcgtctatgcctaaaagcagggacttttaggactgttgcaaaacagcagtaaatcttatttaagtgtttcatgtatgttttcagcttcccttttcttcctttcaggatgaagaattccagaattatgtctgcaactgttattttcttgacatacactcactctttaactcattgccttcaacgctcactacactgtgcttttgaaatgcagtcatctccttattattatctattaatattttatacatcttcattctctttaaactcccagcaaaagtagagaaaaggttaattacccctttctgcactttttggattccctttttggacttttcagctcccgattttttctccgtattccatttgcaccttcaccagctccttcagcaagtcctcttcattctccctctcttccaatgtctatgtgtctgaagctacagctttttccttctgcacctttcttccagttgaatttcgccccaaccctcatgagagtcctctattctcaaggcacctgtcaccacctcggtgtgaccaatttttccatgtatatccttttcttctctggtaggccttacctactctctcccacttttgcctggatacatttacttatcattcctatggtaaatttaactttgatatgccaaaaactatatttgatagaaaagtatatttcttgcttgaaagagagattgcttccattcaagtcataatgtgtaccataaaaatatcaaatatggaaatcaggtgatcagaatatagaaacaatgaaaagtagatattgagaaaataacttttaagttccaaatattacctaaatagtcttgaaatgcaaatgtgtcataatgataagttttactttatttgtttttggttatcagagtcttaaataatgggtgattagcttagaagtcccattctgaaattcattaaaaaataaaatatttctctgaaaaggacttatgcctaaagctgccgtcattctttctcatctggcaccccaagcttcatttgattccctgtttccttattgagcataatttaatgcaacaatcttgcttaaataagtattacaagatccaatagattaactttaactctttatcaccaatctataggcttcatagaaatattaaacaactattgattttaatgtataacattgtcataattcttgttatttagaaacaagatccaatctccagtaaaccactcactgcagcccacacttgttagcataatcaatttatcacacttgttttataaagttgtaagagaaccccacagaagggtgttactaaaaattacagctgatgtaagcttttcacttcatgccaaaaggagggcagttgacgctaccatgaaataaactctactgcagcctctttaatcatttgtcaagatgtattatgtccttgtcaatatcaagggaggtaaacactgtcattaatctgcaagtgaggaaataagtaaccacgtcaatgttcaagtgcctggctgttaatgcaaattcatctttattccatctttctccctctttcattttatgatgttgttcctttttcataaaatgtgcagttacattgtaatgtttagaaaatatacataatgcattattaggatgttggccattgtgaaatttgctgggtgtgcttagcaagacaggcactgacaatgcagtagttaagctgagccagcatagattagtctaaagagaacataccagctataaatttaacaaactgttcattttctaaagtgattgctttatgcatctgcaaatagggaataacagaacattcaactctattttttccctaggcaaataaaaaacttagatcttgaaaagctttctttagaaactttaaatagttattttaattttagatgctgtcactgatgtgttatgcaaaagagggatgttacttacagtggatatgaaatggaattgcagttttagcatctattatttgacttgaattgccacttatgtcttgataccttcctatggggaatctatggcttatctgtatcgattagataaatatttaaagtaaagctgaatatagcagtgttttatatccaccagattacgctacaaaatctagtggcattagattttttctttataggatttttaattgaaaccaacacattggcaatataccttgtttatctagcatagttaccctcaatgaattagcaaatcagaagcttaactgagaaaatagtgaaactctaggagatataaaggctgaataaccaaataacaaatcactacttattgagtttatgcctgtgtaagatagtgtactgtcatttcatgtaatttatcaaagagcactatgaagtatttattatcatgcagacaaattaaatgactttctcaaaccacacagataagaagtcatagatcttagatttgaacccgtgtgactagatgaaaaatctcagctattgtgcaatgggtcacactacttctcagagcaattttacctaggaaaatcttcttatattttactttgaaagatgtccggtgtgtttacttaagttatttaagtaccctaattagggataagatatccaccttcctaaagtcccatatttatttttttagaggaccaacaggtaattcttttataaggaatgtgatagattgaatcacgtagtgattaacaacacagattttagccaccaattgcattttttcaaattatgactctgacatttccagtgtgtgatgttaggcaagttacttaaccactctgtgcctcagtttaattacctataaaataggcaaaattacattgggttattgtgaaaattaaatgtaatgataaatttaaagtaattgaaaaaaggtctgcaataaggtaactgcttacttagcagctatatcttatcatttaaagaagcaatgtctttggctcacatatttgttaacatgaatgggaataaatatccgatttagttccttaatgtctttaatgtcagtatctattatccagtcttgtccatccaaagctttctggctcactcttgctcagtctgtcatttttctacagcattatcatgatataattcatatagctacaattcacttatttaaaatgtataattcaaaggttctaatatatttacagggttgtgcaaccatcaccacaatctaaatttagaacctttttgttccatttaaaagaaacaccatacttgttagtagtcactcctcatttctctcctccctctctgcccagccctaggcaaccactaatccagtttctgtttctataggtttgcctatactggatatttcatataaatgaaattatgcaacatgtggtttttgtggctggcttctttcacttaaagtaacagtttcaaattttatgcctgtgatagcatgtttcagcacgtgtttattatccttgccaaaaaatattgcattgcatgtatataatattttatttagtcttcagttaacattcatttaggtggtttccattttgtggccattgtgaataatgctgaatgaacgttaatgtccaagtgtggacgtatgttatcatttttcttgggcgtgtaactaggagtgaaattgttgagtcaatagccttgattatgttttacttggaggaccacatagcctcctagttgggcttccagtttctggcctagcttagcctgtgaatgtttgtacactgctgccagggagatctttgtagatcttaaatatgattgtgttcatctcatgttcatggcctttagtggttcttctgttgttttgggaataaattatagataccttaacttgacatgcattatttaatcattaaatacttattgggttcctactatattctaggcactcttctagatacttgagtatccttgaaatccttgaaatcatgtcacattggaataaattattactaaaatcagaatcaaatttttgtagaatctttgatttaaaaatacactccttctttagcctatttttcactacaccacggtgcctaggattaaagataaatatggtaagataattacgttgctttccatgttgcattattggcaggttattctaaattatggaataatagcgatgtgttgtgtttgcctgtctctttacagagatgcttattttatgtgaatttccaacatccctgagagaggatcatggcaaattactcacttccatcttacacctagaaatgttgagactaaatacgtaaataaagtacagtgtttgctctactaaaggtgataaatatctgttgaagttaagtccaaccatactaggaagtccctggaaaatttatgaactaatttttagtttttgcctttactaagggaaagaaaagcaagaagtgggcaaatgaaagctgagatgactgcaatctcatcaggacctagtatcctggatgcttttacatcctctctcgtgtttttatttgaaaccaactctataatgttgttgataactgtattactttaaataaattaaatgctaggtagtgtgactactgatttgatttgatttgattatcagaaaccatgataacttctgttctgtaacaaattctaaaagccattaatccaaagcaagatttgttttcaaagctcatccaaatttgcagtagtgcaattttaatataaatgtagttattcacacaccagggccagttgggtggtggggggtgaggggaggaagagcattaggacaaatagctgatgcatgcacggcttaaaacctagatgatgggttgataggtgcagcaaaccaccatggcacacaacctgtgtaacaaatctacacattctgcacttgtattctggaacttaaagtaaaagaaaagaaaattaaaatagaaagtgtagttattatagcataaatatttcatcaaatatcctgtattttcagagaaatttgatcatatatgaatattttatttatcacctattcttatttttaggtgagataatggcacaatggttatgttttcaaaatgcatccttaatttttagaaataataactgaaatagtttatggaagatacacataaggatttgtatcaaaataatgtagggagggataaataggagtagagatgaaacaagattggccatagttttagtttttgtaatagactttatcttttagagcagttttaggttcttagcttaattgaatggaaggaacagagatttcctatatattctccaccccatctatacacagcctccccctacaatttacatcctctaccagagtggtacagttgttgaaattgatgaacctacatcaatacatcattatcattcagagtccatagtttacattagagtcactcttagtgttgtacattctgtgggtttggacaaatgtgtaatgagctgtatctaccattatggtatcatacagaatagtttcactctcccaaaaatcctctgtgctctacctatccatccttccttcccactaattcctggcaaccacaaacctttttactatgtccataaatgttccctttctagaatgtcacatatttagaatcatacagtatgtagacttttcaaataattagcttttttcacttagtatcatacatttatgttttttccacgtcttttcttggcttgatagctcatttgtttttgacatgaataatattccactttctggttgtaccacagtttattcattcgtctatggaaggacatcttggttgcatccaagtttttgcaattatgaataaagatacaatcaacatccatgtgaggtttttatgaagacctaaattttcagctccttcgggtaaaaaccaaggagcacagttgttggattgcatggtaagagtatatatatttttgtgaaaaactgccaaactgtcttccaaagtggctattccattttgtattcccaccagcaattaattagagttcctgttgctttacaagcttaccagtatatggtgttgtcagtggtttggattttggccattctaatagttgtgtagtgctatctccttgttgttttaatttgcacttctctgatgacatgtaatgtgaagcaactttccagaaacttatttaccatctatatatcttctttggtaacatgtctgttaaggtctttactgcgtttttaaattggattatttgtttttccattgttgagttttaagatttctttttgtgtgtgtgtgtgtgtgtgtgtgtgtatattatatatatataaatgtacttttaattgaaaaaattgtatgtgtttatcatgtacaatatgatgttttcaaatatgtatccatagtggaatggctcagtcaagctaattaacatgtgaattacctgacataccattttttgcaatgaaaacacttaaagtctattcttgtagcaatttttaagaatacaatacattgttactaactgtaatccctattttaaacaatagatcgcttggacttattccccctttctaacttaaattttgtgtcctttgactcccctcctcctgccagccctggtaggcaccattttacgccctactgttttttttgtttgttttttttttttttttttgagacggagtcttgctcactaggctggagtgcagtggcacagtcttgactcacagcaatctctgcctcccaggttcaagtgattctcctgcttcagcctcccaagtagctgggactacaggcacacgccaccatgcccagctaatttttgtatttttagtagagacggggtttcaccatgttggccaggatggtctcgatctcttgacctcgtgatccacccgcctcagcctcccaaagtgctaggattacagatgtgagccaccgtgccaggcctttgtgccctacttctatgaattcagtgtttttagattttacatatgagtgagatcgttggcatatttgtatttctgtcgctgatttttttcacttaacacaataacacaatatcctccagttttatacctggggtctattctagttctgggaattttctgagcctagagctgctggggtcagcctggcagtaaggtctgttcaaacaactagtccaaaaggtaagcctggatcttagaggtgcaagatctcatctggcactggggtgtgccgggaggtgcagtccatgagtactggcctagtctaggatagtgggtgtattcatccattctcatactgatataaagaactgcccaaggccgagtaatttataaaggaaaggggtttgattgactcacagttccacattgctgggaaggccttgggaaacttacgatcatggtggaaggcaaaggggcagcaaggcaccttcttcacaaggtggcaagaaggagaagtgccagcaggggaaatgctagatgcttatgaaaccatcacatttcatgagaactcacttactactgcaagaacagcatgggagaaaccacccccatgatccagtcacttcccaccagccctcccacgacatgtggggatggaagctataattcaagatgagatttgggtggggacacagccaaaccatatcagtggggtcatgtttatcactgggttttactggggtaggccaagtgttgtggtctaaggcaaaatccagtgctcacttccttaattttcctccaagtagaaggtatctctcttcacagtgctgcctgggattgggggagggctcacacaggtaatgtaaaactgcccttcctactcttttccatacatcttttctcatttttatgctacacccaggtgctataatctctcaactgatttctttagctcttgtgaaggtgattttgcttgtggatagttgtgaaaattgatgtttctgcagagagatgagtgctggaaagtcctattctatggtcttgctgatgtccatctttgtgtattttgcatgacagtcttttatcagatatgtcttttgcaaatattttctcccatttttcactggtcttttcattctcttgacattatcttttgcagaacaaaaaggtttgattataaagtccatcttatcaattctttctttgataaatattgcctctagtgttttatttacaaagtcatcacctaacctaaggtcacctagattttatcttgttatcttctagtagtcttttaattttgtgtcttacatatcaatctatgacccattttgagttcattttcatgaatggtataaagtctttatcgagattctttttttttttttttggcttgtggatgtccaattgttccaacaccattggttgaaaaggctatctttttttcattgtattgcctttgcccctttgtcaaagatctgtcaactatatttatatgggatctatttctggaatatttatttcagtccattgatctatttgtctattttttttcactagtgccacactgtcttgattatcatagctttagaatatatctcagaattgaataaagtcagtcctctgaatttgttctttttcattactaagttggctattttgagtcctttgcctctccgtataaactttagaatcagtttcctgatattcacaaaataacttgctgggattttgattggaatttcattgaatccattgatcaagggggaaagaatggacactttaacaatattgagttttcatgtaatgaacacagtatgtatttctatttatttggttcttcttttgtaggttattttctgaacctgactaatgggtacataggtatttgttttactcctttacctgtgtattttttacctttttatgttttgcctgtatatgttttaccttttacaagataaaaggctaaaatattttatatttttgcctttgtgatactagttttttggcaaggatggggtaaaaagtaaaataggacattgacatttcgaattttgaatttcaaatctcctatcagggaaattgaataaatatgttgaacatggtagtttggcaataaagggctttggcaaagagggcagattcggtgtaatgatagttctattgagatctagaaatactcctatttgaagagtgaaaaagtgctaccaggtgttcagaagaaaagaaatgttaatgagaaggccaaagataaggtgaatcttatatcaaagtactaaagagaatgaaagtgggattcagttccttctgggtgataagactgtcttaaattatttctcaattatgacatcatatttcccccccatttcttcatcttgcataactttgtgtttaaatgagagtttttaaaatgtgtttaaagctagtaatgtatttgactttgattttgcaaggataacacttcccaatatcctttttgagctcatagaatttgttcatgttcttttaaatctcctgattattagtggtttacttttgatgaaggtgatagcatattcttcatgaaataactatcaagcttagtgttaagataatttaggaaactaaagcagaattataacttcttgatttttatgatagtgtcccttggatgtgtaaattaaattacttattttcatttctaatttttgctaaccatttcagaaaagtggttcagcacaatcgttgccaattctacttcaaatcaagaaatctttaagcatccttaaaagctaccataacaggcctatggcactgtgtgtctttaggagattgatttcttttgtgggtattctgtttacttaatgacataaagaatgagtgagggagaaggcaaaatattctcccaggaagatggagaagagtggtcattgtggattagttaggcttttagtaaaaacaacattgtaatgaccttgtgatttttatgaaaccacttataacttggtcttaatttacaaataagttcctttaagtttgcatcaaaagtacagagctctttcttgttattcttaacaaggtttgatacacagcatttcctcatggataatttgtgggtttaaaaaattgaaatgctattattggtaactatcttggtcattgttgcaagatgatttctatagtgggagcatcctttcatacaatcatacggatccttttacggtttttctggttataatatcagtaaaaagtaccacttggccacaagtgacttttgtttatacgttgaatgaaggaagaaattatttctaggtgtgcaacatggagaatatttaaagttctcggaatgtaagtttcttcatatgtcaaagaaggtgataatacctaattttaaatgatgttgaaaaggttgacatataacttatggaagtactacctacgtacccacctacctacttacctacctacttatctatctgtttttatgtctatctgtcatgcttagcatagtaactggcagattgtaggcagttaggaaatgttagttgtcttctcactcatcatatcatgtacttttaaagggatggttttcacatctgtgcaggttgtctactgtaccactttagagggcaatgttcatgtagcaaatattatgaatggcaccactggaattctgtagtatgcaacttgaaaaactaaacatagtgtctgtatatttttaaccctctatgttggtgattctccaaaagggagcaattaaactcttgcatcagaatcacctggagatgatttctaaaaatgcagcttcttctgttcatttccagatctacctaagcagaatccgttgagatggaacatacagatctgtattttttaaagctgctgaagtcattattttgctaacagctatcttataatatgattcatatatcatacaattcacctattttgcccaggtcattcttaagcatgctgaaccattgctctcttgattgtctttgtgagaaaaaaaaaaggtgtcccctggtcttttctttctctgcgattcttcatggatcaataacaaattcttgcacatattgtattgtacatatttcttctataactttcatcacattccttcattcttagtgcttaatctccattttttcttctagcttgcatgcatgcatgagcgtgcgctcacgtgggcatgcacacacacacacacacacacacacacatacagagacacaaaggcttagagtcaaattgaactgagtttgaattgcgggtctgccacttactgtttatggaaccatgggcaagttaccctttcttgattaactgaaaaatgaagcccctaataccaattttataaggttgtatgagaataaaatggaataaaatgtgagatgcttattatactgtgtgacaaataaggctaataatatgttttcattaggtcgtatgagaataaaatgtaagttgcttagtatattatgtgggacatataaaaatatgttagctataattaaatgagagctataattaaattgaagacagtaatatgtactcccttatattccttgaagttcctaattttaataaatttatcaatttattgattacttactaaatacaagatactgtgcctgatgcagtatggaatataaatataaatattatatgagctctgccctgaaggactttgccgtttatagtacacagataaccaaatacaataaatatttcatgatggaataatagaacaaatgctagagtggattttcacaaaaaaatattgtcagaacacagaagagaaaaaaattttatttgagacaagcactgaatcagatttcacaaagagggtagaatttggtctgggactttaagggtggttgaaacatgtctatggagaaagggaaatggggtttggctgagatatggatacacggtggagagtttgggagggtataggcgagatgggagagtcttgatcttagaggataacacacgacaactcaaagtctttgaatgacattctttaagctattagaaaccactcaagacttttaagtaaggcagtgacatccgctgttccatatctaggaaaagttgttttagtggtatgtggaatagtttcaaggagtcagggataggaaatgaaaacaccatttatagggttcttcggaatattagcaggattgtaaaacagaggttaggcaaagaaggtgcaaaaccatctttcaaaattctggacatgtaagatattttaaagctcccaaaagtgaagttttgtgcaaaagttaggtgttgagctagggcagtaccaatgagaatgaaaagaaaagggaaaagcaagaaatgggacacacacacacacacacacacacaaacatttgagagataattggatgaaataatggccatgccacataaaaagaaattatagtacctgccataataacataaatttattccaaataaatcaaatgagtctaacttggaaaccacatcagtcatttatattattgtctaaaaccttttttgacaaaagtgaacacacatgtcaaaaatgttgatacttctcacttcagaacttagtccattttcacatttattcaagtctttatgtcgcaagtattttatttgtatgtagatttttagatatttatgattattttattttctaatgctgatataagtgaaatttattggtttgtcttaatattctgattttgtaaccgagttctctatttagttctaagtgtttttcagttcatatttgatatttttcagacaatcatctttacatgactgctttaccttttatttttcttgtgttataatattagccaggacttctaaagcaatattaactaatatttgtaaaaatctggctacttgtttttaacttaagctttcgaccactgagcaggctgttttaaataatcttcatttgataaagaatggattcctctactcttagttggttctgaatcatcaagatagacactgaattttatcaagtgctttcaatagacttttaatatttttaacatgaaatgtgcctttttcatgtcgttttctggagtaacatttatactagttttacaaaataagttaggaattcatctttttagtgctttgcagtaattttattggctttagaatctttcatttctggaaactttccaagtgtttattggtaaaattattgaagcctggggcttttcttagaggaacttcttcaccagtgtttttaattcccaatatgtattttaaaaatcctagaataaatccatgcaaagtatttaattcttttttttttttttctttattgagacagagtcttgctctgtctgccagactggagtgcagtggcgggatctcgcctcactgcaagctctgcctcctgggttcacaccattctcctgcttcagccccctgagtagctgggactacaggtgcctgccaccacgcccggctaattttttgtattttgtttgtttgtttttagtagagacagggtttcatcgtgttagctacccacagtagctgggactgctaattttttgtatttgtttgtttgtttgtttgtttttagtaggacggggtttcaccgtgttagccaggtcgatctcctgaccttgtgatctgcccgcctcggcctcccaaagtgctgggattacaggcttgagccactgattatcaatttgcctttccaatgttaaatctccaataatttttaaaggaagtattgttatagtgagagacagacacctatgacacatccatggagcagaataatgaatgcaaaaacagcaatgaatttagatccaaatgtaacatattaaaaagatttcatttcaaataagggcaaaaatagtttatttttcaaatgatgtttgtaattatgataccatttagaaagaaaaaagttaggtacctactatatagcatacacctaagttaactttaggcgggttaaaaatgttaatgtaggaaggcagaaggcggagaattgcttgaacccaggagtcagagctgcaatgagccaggatcgcaccactgcactccagcttgggtgacagagcgagactccttcttaaaaaaaaaatgttaatataaaaataaagttgcaaaagtactagagaaaatgttacatgaacattaatatagcattggagtgaaaaaaatgctttaaagttataaaccataaaggaagaaaggcatactggaaaatgactaatgaatttaactatatcataacatttaaaggttgttcttaaatatttgaactactacccaagaatgcccaaagcccgtggtggaaattctaatttttattgtgatatgtttgtcatatttaaatgataggtttttgttttaacattccaaaatgcagctcccttttctgcctttgactgccttctatagaaattcccccagctgccaggccaaatttctcatccagattcaggtactcttattgactatccaatagggcattgatgctgccaagttcgcattaactctcttattagcttcgagaagacttgagacagaagctatcaacacttcttcattggcatctatgtggctgtgaaagatggtcacattttagtcaaaagacataatcctgtccagttatatttgaagagaatcatagctaaagaacacatgccatcttccactcctgtttttacagtgttcacaaatataaaatagttactaacttcttatactctttccacctgtaacataaagatggaattctgcagaaattgagaaagagggcaaaaacgcggattttctgagataatttaaaacagttaagaatctgcagccaataagaatttaactcacaaaggcagagcaattgaaactgtttccggccatcagtacacaaatagcaagccaagcttcataattctgtgtttaaatgcaagagttatttaaaacaatttggttttagtttattttcttacatctcttaattactgctggaaaatattgtcaaggttgggaagttcttttaatcaaagtctagaatattaaattttagaatctatagaggtagaaacatcacaaccatttatttacttttatctttgaataagcattgggaattatgattcctttagttttcttacctgcaaaaacctgtatgttcttcatctaattcaccaaaagtctattattctcaaaattctattattttgagaaataatagaatcaatacaggtcaatttttaaaatgtgtgcaggactcagaaccattaatgtgctaatgtgcattctgatgttccaaggggcattcataacatccagcctgtcctataaatttgaacctagaaccctttttgcatgcaatatctattgagttctgttgggaatattgtattactcgaaacataattttgaaagtgctactataagagcttttagaatatgtggtgttaaaagctgtacattatgttaaaatagctcttgctattaatacatctaaataatatttgttgaggacattcccttgaaggccctgtgctaaatggctttgtaactaaacttctgttctgcttcagtgttatactgtggattatatctgatgttcatgtatgaacataaatatgaccagttaaagcaatttcttgccagctaaaagaggatgttttatgtctgattatttaattcaaaaagcaattcactagtcttacctccttatttgccattgtacatgtggttaataagtaaaatctgaattcctaacaatgtcttttagattaatatgttttggttattgacacttcatacatttttgatatggtcaaagttagttcctagatagggaggagcaggatttttctcctcttgcttaactggtttctaatttcttgtgagattcctttatgtgagtttcaccatactaaaaatggaattattttaaaaaattataaaatagagtccccttctctattttaacaatcaatgtacctctgaatcaactggttattcccgtgatctgtgaagtagttaccgtgcttttcaaattgtatttcatgtgtgttcaaaatgaaggataatgactcacattataataaatagtatgacatttatgacccacaaggaggaggagtgtacaaatgaactttaagggttttaccttgaagatttgtgagatacaaaggcacagtttttctaaaacaggaatatacctcagctgtcaggaagaactagaaattatagttctgccttattgggatatagcatgagtccagtgacccctgttctcattgttcatctatctccaacacttcttgttaagaagacacaattaggtcagttttcaatgatccaatatggaacacctctgacaaacgaggtttcaaatcaaggtatctcagacagttggcctcctagcgccctgtcatccctttggcttatgcccaaattcagcccagagccaattagtggatcacagcctctagaatggcttcactctgctcacactcaacaagatccagacagagctgctatgcaaaaaaaaaaatgttcacagggtcctttcgcagaggggcaatggtttaggtactttgagacttcatggcgcatcaagtacacacatgttgaagtaatgcaagtgagaaattttgctgacaactgatggaaagtaacatttaaatctagagctctacctttgtgggcagcctgagacaaccctagattaaacattttaatttttctatttactgtttgtaggtttctgtaattcactgagcctgttctaatatgtacaggtagatatttgcacctagaaagcatgcatcttggatatttatcatatataaagaaaaaactatatatacagccatttaaatatgctacaaatagtaatagaacactaataaatatgtacatgaaatgagtatgtgtttatccttaaattagtggtttggttttcaacattgttttattccttgacactgtccccatgacccatcatgttctgatcactaatattctctttgaccaaaccatgcttctggagtgggggccattggtactagtcttcatgtgtggggacaaagggacagagttttaaaatatactgttgagactttttccagattagagttaatttagctaatgtcatcaagaccaatagttgttaggttaaagtggggaatcattaaaaaattgcacacttgaagtaaacattttacttaaaatatacaagtacattcatttattaaccttttcttctagggtcaagaccttttccttaaatattggattccttagtgggcttctaattctttcttaaaaaaaaactctacccatgatgcatcatctacaatttccaatttcagtttctctaaaggagagcaaaagcataacggtaactctaaagcaatatgcatatagaaaacttatttatttttttacttatccccgtctttaagaattgactcatccacacctaatttaacagcagttgttttagtgactcattttaacccattcttttcaaacgttttgtcttacttttaatagatacaacctttttttgcactcacattttgttcttttgttcaatttgtaattgcataattacattacatattaaactagtatacatagattctggaataaacatgccagactactattaagtagacaactcactggtcaaggaagcatacagaatgctgagggaacaaacatggcctttaatccagcaagtctgttataaaaaaaaagctcactctcaaagcctccttctggagttcataataaatgcttcccagggaggcagtcctctgctctgctttcctacttcttttcttctttgaaggtttccactttaaatcaggcaatactgtctgttgaatactgtctttctcctgaatgaattgttttcttcttcctgtaaaaacggaattcaggatagttttagccctttggtgtgccctatttattgagaaggacattttctgttatgcccagaagtttaggagccttgcatggctcgggcaagactgaagaagcagctcacttcagcctgtttctctactttgtcccctttgtgctctagcttttcactagtggaaatcgcccactctatcacaaatgttttcagaggctacaatccaacttaaggaggataagctatgagcaacttgaactataataatacatgaacatcttgaactataatagatttagaggaagtccaagaagtaacaatcctcaaaaaaaaaaaaaaaaaaaaaaatcctgaggcagtctaatggcaactggccaaagaccaaatcaagatattaaagttgcctgatttagcatccctcaggagatatgcttccaccataccctatatgcaaacaacaacaacaaaaatagagccataaatccccatcctaattgtacaacaaaatcatctgtggaatttttaaaatgcagatatctgggtcctctctaacaattatcaaattgagaccttccagatcaggggcctagatttaaaaaaatgaaaaacattatgggttattacaacggtcagttacatttgaaaagtcagtttaataaagacatgaaatatatttgtactgttggaaaagtgagtttctaagtgatattttcctccttacatatggatgttccttttagtctatgatagcttctaccttaaaacacaccttctgatgtgaatctgcatggggaaaaaagtggtcggctcagtgaatgggtgacaggcaagcagcctctcctgggaggttctttgctgtttcctctggacccaaaagagtcctcttgcttaaaccagctgcttctcaaaacattaaactgcacaaggatcatctggggatagagtgttattaaaagtagatgttgtttcagtaggtctgagatggggcttgaaattttgcatttccaatgagctctttgtgctgctccagagaccacattgtgtagccagggtttaagccacattaatccaccagttttcaccagctgcaactaattgagtgtcaaaatttaggtctacattgtctcttttccatttacaacttctaaactttattaaaatccatgaattattactctaaaaaggaaaaaaataaataaaaagaaacccttttcactttaaacaaagagataatgtgtaaggtgtgttcacgctttatggtgtaggttttttgcctgtgaagaccaggaagtgggtcggctcctaatcaagatcagatcaggtgattccataatggaactaaccacctacagtttccccaccaggctcatgtcagtaaatgccagtgacttctttgtttcaggtttatttgctaactgtagatgttgcagatgattggttagtgtgaaagcacaaacatggtgaaaataaagaggacattttacctttcttctaatatattatatttggtgtagcatttctagtttaataggaattgtcctcttttatagtggaatgagttttggactgaattctaaccaagagtgtatgaatccttcttaatgatagctgtgttatcatgtttcctcatagagcataaatattttagcaaatgttgttactgagtttgtcttcaagcagcccagtgaatgtctgcacccttgagtattaaggaaaaactcattcttttcacttataaaaaggcatatgatgtagagaacattggaagcctatctcaaatcttaatctgctttccctgagatcccatgggacgtatctgcaggcaggggggtggaatttactctcaactttattgctgctatctggtactctttgtctgcatgtagccaccaacttttatttatgagtatttgctggacctcatgctaggtccactgatacagcttacagacttgagaaagatatcctgcctctaaggagcttatagtctagtttatctcaatttatacaatttatacaagcaaccgagcagaaaattttacagttaaacgatgatgtgttgttttaaagtactttcaagattcattgtcagtttgtcttcatttgcatttctggtaacaaagacagaaacagtatagactaggcaataagtaagtgacagtgtgctgaaggagaaaatgatgacaaagaagatggagttgagatgatgggaattctaataacccatataccgtgtattagttctttatttcttctacaaacatttactgaacacctacttaggttcagccaaaaagatgacagttttatgataacagtatgtttccagtacagtataattgttgtcacaatgagctgttcactaaagcacggacattctgtcatctcatctgtaaaaagtagataataatatcctccttatcgaaaatcaatgagctggaacaagtgatttctagttttccttctatgcagtaatagctaagagggggagaaaggaaatgagaacaaatatgagcccgagtttacaatgtcttcctgggacagtatcagaaatgaaacctaatttgtagtgtctctgataaaacatgagcttcatcttctccttcttcccccaaaagatatcaattttcattttaccagtttacccctactagctggagctcagaacataggcccacatgcctatttctgccatgagcagaacaactatatttagatattccagattgttcttattccatagaggcccaatgaatttggtaactaagactgaatggaacttggtatctcatcagtgcctctcaaagatttcctttcacttgtttcttcaggaagacaactactagttggacacataaaagttttaactgtggctaggccccactcttctctagttcccattggaactagaaactgttgtaagaatgactccaaggaacattaaagacattttcagattgactttgaaggcacatataagtgtgttcaatgactttgtaatttggggaagactcttaaactccctattagcagattatcatatataacatatgaatagacctgtttgaggatgtaatgagctcatgcatataaaataactagtaaagtgacctgtacattttcagccctcattgtaagcgtaattatattatattattcatcttttgtaggaaaagttttattgaattggagaacaacagaagacaaaagcgttcctcctttccctttctagatttgtatatattacagaacacacataaaaatggacatttctctgcagattatcttactgttatgtataaaaataataaattggctctctgcctatggagcagacattcttttgtttctttacttctctaataaacttgctttcactttaccatagatagcaatagtaataagtcatggagaaaattaataactacttggactttctacgaaaatgtagggaaagtgtatatagatttttaattgatgttttgattccaaacaaaagaaaaaacttcttacaaatcatttaatttaaagctaaaaattgccttagatcacacatctgtcctggttgtactaggaaaattgatataaatattctcatggctgtcacacacctgttcttcctaaggcagttccatctgaggcatgatattaaaaggaatcagaggtgctcaccaagcaacataacacccttgactaagacaccaacattgtgatgatgtgtgaaatacttacatttctctatggctgccatagtaccttatattggcttcagatctttttatgtttgtgatctctttatccatgaaatctagtttatttgcccccttttgaaaatccatcccctatcctcatttttaattcatccattcttcttcctattcagagtaacctacctctcttaccaagggtgtggccagatgtgatctttttttttcagggccttaaatccagcaaattatgtcttgaaataatgacacgtcataaagtcacttaactttttttccgagtccaccagttctttttaacgtttttcactgtctaataaagggtctaaagccctgactggaatccatgcatggaggtgtcaaagcttaccactgttataaaaatatttccccctacatggcatgtcttcatttgggcatgaatcatgaattcatcccatgcgttctcctttatttcatgaacacccaactgtgtcagaatgccaatgaccttcattggcttggctaatctatggatctgaaccctcctgtaatccattaaaagaataatagcaaattgaaagtgaatgtaaagatacccaatgggaccataaaactaactattcaatgtgacgtgctttggcttaatagggcttttatttatttaatttcgagctccccttggtttctgacagggttagtggaggaaacaaacccagacatcttgtaagctgtcaagctgatactcatctcaggggagcttagagggtatcatgttttaagttttatttttctggagcttggaatatgtctgctgacagacggctcccctgggttatagcaatgcaaggctgttgagacaattgaataagctgaattagacaaaggatttttattacaataacaaccagatggaactttgaaggaaatttttttttaaggtcttagaagttctgttacagaaatcatttaaaacatatttatgggctgggcgtggtggcttatgcctgtaatcctagcactttgggaggccaaggcaggtggatcacttgaggtcaggagttcaaaaccagcctggccaacacggtgaaacccacctctactaaaaatacaaaattagccgagtatggttgcaggtgcctataattccagatactcaggaggctcaggcaggagaatcacttgaacctgggaggtggtggttacagtgagccaagatcgcgccactacactccagcctaggcaacagagtgagactccgtctctaaacaaataaataaataaataaataaaaagatatttatgatgatttttcctattataaggttaaaaaaaacaacataaagatctcattgctctgttttttttaatccctaatgattaatatgtggccagttacagagactcttccagccaacccgtgacatatacacattaataatgttcttttgtatttgcagatcttatttcttcagagtaatggaaaatcctgcccagtactgttctattaatcttcataacgaatgctagggggctaggtgggcggcatttggtgttatccacatgtaatagattttttaaaaatggggcaatgaaaacaaaataagtcttgaaacttgttaacacccacagtggaagtttagcagtggaaatgaactaatattaccagaagacctcttattctctattgcttttcatgattagctagtacatttattatttttctcatgaatgacaagattgcctgtaatgtatttgacatgtggtagttttccaatctccggcaggctgtgtgcatgggtgtgtgtgtatgtgattaataaatacttaaatattttttatatagggattgttttgccctctagaggcagctcaatagaaggagcattcaatgttagtgattgaaaaatggtagatgaaacttggacaggaaaactcgagaggtccaaggtaccttatttagctactgctgtcacggtggatcataatgcagtgggacagtcaggactcaaagcctttcctataaccacatacgatggatattgagcacaatacagaagcaaaagatttgttttaacttggatacttcaactgcaagcgtctctgggcctgatatccagttcagaattcactgtactttttatttcactatcggctttccaaaatatggtaactaaatgagtaaatgaaaacatggcaatacaaaccaacacaagttcttttgctgacagagcatgcaattgccaagtaaaaatattgttctttattaggtttcttttcatcgtacatgtacatattcatttggaaacacatttttttgagacataatcttgctctgtcacccaggctggagtgcagtggtacaatcatagctcactgtagcctcaatttcctaggctcgagggatcctcctgcctcagcctttcaagtaactagaactacaggcatgggcacttgccgggctaattttttaaaattattttttgtaaagactgggtcacctcagccttccaaagagctgggaagagctgggcatataggcaggcatgagccaccatgcccagtctacaaacacattttaaaaccataggccttctagttttttgttgttgttgtttaggttggcttttgacatgctacttattgcatactagtctgtcatgttcctaaattccagttactcctgtagccatttttaaagattattttttaaatttttcttcctcctcctccacctcctcctcctcctccttcttcctcctcctcctcctccttcttcctcctcctcctcctcctcctccttcttctcctccttcttcctcctcctcctccttcttcttcttgcttctttttcttcttcctcttcttctcctcctcctcctcctcctccttctttttcttcaggcatggccttgctctgccactcaggctggagagcaggggtgcaattatggttcactgcagcctcaacctccatagctcaatcaatcctcttgtctcagcttcctgagttgctgggactataggcatgtgtcaccacaactagctaattaaaaaaaaaaaaattctttttagagacgatggggccttactatgttacccagactggtgttgaactcctagcctcaagcgatcttcctgcattggcctcccaaagccctgggattgcagggttcccaagtggccatatcattggatttgtcttcagagtgatgtacttgtgaaacatggatatgaacagggatagagggcaatagcaacacatgtttattaagcactcattgtatgccaggctaagcactttgtcacagagagcctatttaatcctcagaagaataatccaatgaatcactctattttctaggtgtcaaaaccaagtcttaaataagccaagtaacttacccagaatcatatagccacagaaccgagatttgaattcatacattatgacagagtcagataagctagccatcctgcccctacctccagttccagaatcagtgattggctttggtcttactcagcactgtcagttacagaaattggtgtcatcagattatctgtctgcctaccacctctggagcatggcaattacagcatcattgatttcgattgtcctaaaatggaggaaaacttgctgctggcaaaaggaagacccataatcattcatcagctcaataggcttgaatggctaaagtgctcacagccatcttcctgtctcactaattgctgccatttaaagataaagggggaagaaactaccctttacttcagtttacaaaacccaccgaagttaagatataccaaaggatgtatccaagaacccagaacttctggatggaaggttctggaattgaatcctcatgccctgcagtataacctccatacacccacatggcttgggcctcttagttttgcttggctgctactacttttaagtaaaaaaataaaaattggttatgcagttttcagaatgtctttcatttcaaatacattcttaatccatcaaaagggacattctaaataaagacttgtctctacatgatgtgttaatgaagaatggcaggggcaagtaaaacaaaacaaaaagctatgtagtgaggttctttcaagccaaaccacagctgtttgaagaatgacaatatgatatcatgcaactgccactatccctcattaattgattttacagatttttaggtattcactgatgtgtcttgtacttatggctgaaaatgcacactaacaatctgtagcaatgttacaacacagatagcatattgtcaaatgctgccatggatgaaaacttctcatttgctgtggatctgttaagataaacctcttgagaattacagatacatttattattggcattttcaaaatggcaaagacatctgttgctaaaagtctctgactggaaaggatttgggaccaagggtaaggttagctaacacttcttaaactagacaagtatgaacagtgaacatctgaaactacctgtgaccacagagcccaagtaatgtttaatggaggcatacatctttaaccattcaatataaattcaacctttttttttttttgagatggagtctcacactgtcgcctgcattggagtacagtggtgtgatctcagctcactgcaacctctgcctcctgggttcaagcgatcctcctgcctcagcctcctaaattcaacctttttttaaagttttcctcattaactgaattgggcacttccccccctataatctcttacataatttgttttaattcttttgacgtatgcattacataccacccttgtattggaactatgtatgtatctctttttcattcactcccctttccttccctgtcccattccttaagagaactgttatcttccatgagggaagcactcctgcaacttttacgtgtatgtgtgtttgtcaccatcttctaccacgtattaatgtcacatattaatgtgccagcccatattagtgtctcattctatgaatgaatgaataaattaatgaagaatgaattatgtatgtaatgtagttcaacttactacataacaccaagtaaactaaaccatccaagataagtttttgaatcaaagccaccatcctactaataaatatggtttcttttgtataaaggtgctagaattcctagccaaatattttattagtgttctatgccaaaacttccattcatcaatgacttatttcaatgataattacttcaagtctctgagtgtaggtatcagatgttgaatattagtatcctggtgctcaaggagtctttcacaggcttttacatatgcttctccatgtgattccaattttagcatacaaatcttttatttactatcaacctacttagtctacttgttgagaaaaaagtgttcatcatatttcttgattctgcatatcttatcaattgcaatttttctgctctattaatgtttagatagagaggaaaattagggaaggacaccaatcctgtgtgtaagacaaaactggaagtcattcacaaatacaatatgcatcaaatgttttcttctgagtggttctatattggttctaaatataatagtaccagcttatatgaaaagcatgagggattggcctcaccagtttttatcaaatgtaagatgctattaatttcaagatgcatcactcttttatgaaccacaaaggaagaaaagaaatgctgccaaattaacaatgatgttgttgatcataagttatatcttgatttcagagatattaaaatgggtttagaatgtatgtcttagaatagacgaaatatagtatttgttcagtaagtatggagtgcattctcaatgctctattactttcaacattgatatgcttcttttacaaatggtgaagatatgatagggtgtttgtgacacatgcttttctagcaatctgtctaaaacctagcatgcattgcaagacatgtcactgcaactctgcatgtgctaccacagctttccagaaggtaacatgcatcccacaaagcttccaaatttcttttcagaccgttttattggcctgatggcaagctaactcaaagcagtttgccatacacagaacacattcaccaaccttggtataatgttccctccgcttctttctaacaagtcacattttgccttttaaggttatccatcatccagtgttttaaagcattttgctttcaatgaggtggcacaaaaaaccatatttttacaatagccctaagttttaatggcaggcaaagagaatatgactacatatctcagcagacaattagagtaaggagggtgaggtaagaagagtggtgcaatggaaccgtgaagatagggagccctgaccctttcattttctgttccgtacatatttgaccttcagtcctgcaattgcagaaaacaaactgcccaatcttacccatgggacattttgtaattactttcttgtctcttctcttatgggtgcattgactagcacatagtacttctgctactgatagctcatatttatctagcactcattatgtgcctgacagtattctgtttcacatatattaattaaactgattaactttttaaaataaactttttattttgaattaattttagttttacaaaaacattgcaaagataatacagagttctcatacattttttatccaattttgctaaatgcaatgttaacgtattatacaactgtggtacattcgttaaaactaagaaattaatattgataaattactgtaaactaaactccagacttcatttggatttcaccagcttctccactaatgttctttttctatttcaggatccaatccctgttggatccatattgcatttaattgtcatatctccttcacctctttggatctgtgagagtttctcagtctttccttgttttccatgactatcacactatttttttcagagatggagtctcattgtgttccccaggctggatttgaattcctgggctcaagcaatcttcctgccacagtgtccctagtggctccaactataggcatacaccacacccggcatgactatcacacttttgaagattaccgattgagtattgcataggatatcctttcatttgagtttgcctgctgttcttccgatgattggactttggttatgggtaactcatccacttttcacaacagcctataagacggtactattatgattctcttttatagatgaggcactgagggagagaacagttgagtaatttgaaggcctgggtgcttgaatccagagggtctggttatagacctaaagctcataatcactatgttattattgagttataatttctaaatttgaatcttgacacactacatactaactcatatttattggtatcagatcactcaactgtgaagcaggaatgatcattttacttacctcatatggcaatgcttagcacagtatctcggtcacaccaaatttctggaagatgttagctgttagttttacttaactgtttgccattatttttcaggaagctggccatgttaattttctgaactgcacaatcacaattttgtgaaccttaaggtgttctgaaattacgggctcgttgattctgccctttgtcttgcttctcaaagaaggtgtgctggcactccatttaagtgctttatttgtcaggagaaagtgctcatttgaatctgaaaagcaatccatgtacaaaggaagaaaacttggaaaccctgatagtctctgcatgtttgagaatcaatgaaaaaagtaatgccactttccacatgtgcttttagaattctaggaatagatcagtctcaggttatactacaggaataatatctttaaataacaccatagaaaaacattccaaaattgtttggtagtggactgtgtctacacagatacttatacatgttttttggaaggtcatattatgacatatagcaatatcagaatttctacaccaatagcattaaatgataatccctctctgtcaaaccggaacatgtgttgtaggtaagcatgtacataacagtgtcgatatctttgcctgaagtaagaatattgagggaaaataaaagcgttatgagatgtgttcctttcattttaaaaaatgaaaaaattactccaaaatggtgttatggactcaacattgattctcctggtttccaatcccacacaggttgagttcttactacaacaaggcattttccttggtgccatgtcctagatcatacttttctgtttaatgcagaattttcttccaggaggctagaatgcttggaaaagtgtttgtcatatgtcggaaagtgagcattttctcttatgaaaactattcgtgcttttatgtaaaagtattgaaaaggaaacttcacaaaccataagaaaatacctgaagaggagatagaaagcaatccggctggggatcacgtagcaagtgtcttcattgggcagggtagaaaccttggctaccttttgctgctttccaactctgaaatcctaagtttctctgatgttaagttacctggttgtaattataaagtgcttatcattcagacgtatgtgaaatacttggaagtcagacttcctgccagtgtttaacactttggaaggatcaataagtaggctttattcagatattccaaatggccaccttcttggtgtcatgtgacgctatgtctgtggcctataatacatgtagttgtgattaattgacttttgtccagcatcctgtattttcggctctcttttagcggtggcaagcaatggaaaacattatttctttgctcagatttctcactatatgtgtaaaaaggtgatattgtgattccatgtttccaaatgagtgagactctatggacaccttccatatattccctccatatcaggagtaaagaaaggtatgtcccaatttaaatgggaatttagcacctctattaaatttttcacacagcttccattctgtatttttatgaactataccaaatcaaacatatttatctttttgttcagagaaatgaacatgaactccttatttctgttaaacctgcttttcttgcagtcttcactgtgtcgaggatgtctattccatcccactagttactcctagggaaaatcttggggtttaactccttcctctcacacctcacaccctaaccatcaacaaatcctcttagctttacctccacagtatgtccagaattcagtcatttctcgtacctctcttacaagcacccagttaaagccaccatcttcacatttaaaattccctgtgttagcaattttgaggtatacaatacattattactaactatagtcacctggttgtgtaatagatcaccagaatgtattctttctgtctaactgaaattttgtaccctttgaccaacatttccccttttcctaccctcccccacccacctcagcctctggtaaccaccactctactcttatcttgtctgaatttgaattttcagattacacgtgtaagtgagatcattcaatatttatcttttaaaaaaattttttttgagatggagtcttgctctgttgcccaggctggaatgcaatggcatgatctcagctcactgcaaccgccgcctcccgggttcaagcgattctcctgcctcagcctcctgagtagctgggattacaggcacctgccaccacgcccggctaatttttgtattttttagtagagacagggtttctccatgttgtttaatttttattttagttcagggatacatgtgcaggtttcttatatagataaacttgtgtcatgggggtttgttgtacagattgttttgtcacccaggtattaagcccactacccattagttattttttctgatcctctccctgcttctatcctccaccctctgataggccccagtgtgtgttgttcccctttatgtgctcatgggttctcatcatttagctcccacttataagtgagaacatgtggtatttggttttctgttcctctgttagtttgctaaggataatggcctccagctccatccatgttcctgaaaaggacatgatttgttctttttttatggctgcatagtattccacgttgtataagtaccacattttatttatccagtctaccattgatgggcatttaggttgattccacatctttgctattgtaaatagtgctgcagtgaacatacacatacatatgtctttatgatagaaggatttatattcccttggatatatacccagtagtaggattgctgggtcaattagtagttctgtttttagttctttgaggaatcaccacactgctttccacaatggatgaactaatttacactcctaccaacagtatataagtgttcctttttctctgcaaccttgccagcacctgttatttttaataaataacagcacctgttgagtttttaataatagccattccgactagtgtgagatcagttgcttttggaattttcatcatgaaatctttgcccgttcctctgtccagaatggtattgcctaggttgtcttccaggaatttatagtttggggttttacatttaagtctttaatccatcttgagttgatttttgtatatggtgtaaggaaggggtccagtttcagtcttctgcatatggctagtcagttatcttagcaccatttattgaatagaaagtccttttttccattgcttgttttcttcaactttgtcgaatatcagataattgtaggagtgcagctttatttctgagctggtatttatctttctgtgcctggcttatttgacctaggataatgtcctctagattcatccatgttgttgcaaatggcagattttcattcttttttaaggctggatagtagtagttcattatgtatgtataccacatttgttattcattcatctgttaatggacgctaatgttgtttccaaatcttatcatgtctctctccatctcccttagatcaaaattcaaattctgtgtaacatatagaaagacttgccccctttacctgactgagagcatcacctctacttctctcttccccctctacaccagctataccacccacctcactgtgtttcaatatactattgttctcctgctcagaagctttgaaattgctattccctctttttgaaatgttcttctccaaggtattcattttcagagtttgctccctcactttattcagtctcatcagagaggcctttcttgactatccgaaaccaaataccgctgcctcccacttacccctcagtctccttattacgctttgtctgcatatcgcttaccaccacctgttaaaagataaagctgagctcattaaacatttaaagattttatttgagcagactgattcataaattaggcagcaccaaatcacaagctgtatgggctccaccaagaaggtgtgagaggaaaatttttgtaaggtgttctaggaagcaagacaaagaaaatatttgatttattgaagtggaaagtccctagttagaaattagttggcagtttcagattaagttaaatgtttacactgaattgggttttggtttgtctacataggaacccagggcactggagccatctcagcctagtggcctcccaaattattttttttcgacacacgtgacatactattttattttctgtctttatccattacaacgtaagttccatgagagcaggaatgtatctgttccttttgttgccttatcttcaaaatgtagaatagtacacaatacttaataggacattaataaatacttgttgaacaaatggaagaatgactaaatgtgattgaaaggcagactagtagtaaattggactaggtcaaatacatgtgcagaccagtgttcaatagtatgtagcatagtttatatttacacatattcaatatttagcctttcaaaatgttttccagttacctaaatataagtatttagcattataggtggaaatctgtcaaattattttaactcataccacatttgagaaactgtgtggaacctttactattcctcagttttgtttttctataaatataatatatatttccttttcctactgaatgttcccctcagtgcaatttttttccagctattttacttgtagttttgatgtcttgctttgtttttacctatgaagtctaatgaaagtccagataagagcctataattctatccatataattcagtaacttccagaacatgttttatctgtcagactatggttcacattatcgtaggtgtaatgcaaagtttagagctgaaaatgtagccacgttcctaattcttgctctagttatcaatgtcaaatgcactatcaataggacttgaaaaacatactcagtaatattggatgggtactgacattctctcaaattatagtattgagtgcgctatactaaaaatagtaaaaataacatggcttagacaagtgagaaaacaaagctatgtcctactttattttgagaagcaaaatacaattttcctgtttgttttttctttttctcaaaacaactaaaatttgtaggaggataatgtttaaaatttgttcacatggttaaaattagaaaaataaataaactgacatgaaacatacattaaatttaaagattcattgttttgtataaacacagtgtatagcttataagtcattatgctattagattgactttttaacttacgagaaattggcattctaatttagatgcatgtatatgacttcccatgtctattttaggatagatttaatcataaaatgatttaccttgggcaaattacaataaactcacttgagtaattaatcgaggtgtttcaaggagttaatttagttcacgtaaataagaacgttgtttcaaggaatcatttaccactctgtattgccatttggcctagactttttccattttacatccagaagacaaactgttgataaactatttgttatttttttgctaaaaattgatacctttagtatagatagtactgtatcagaaaccatagaaactgatgctttaatatggacatgaactcattagacatagaattttggtcagtctctagttagaatcattgcttctatttattttcaagtttgtacctgaggataattaatattattgaaaatgggttaatttgcaactgaccttgaatcacaaagtggtaggaaaggagatctcttgttttatttatttatttattaacaataaggatttgggcattgtcatatgcattcttctgtagcttacaattaccacaacacttcacatcaataatatactggtgctgatttagtttaaatctttcatatacgtgtttattgtaaatttctttgagtaatgctgggcactgatattaacagaggattaactttatggcacattttaatagaatgcacaatattacttccaccaaattttcttcttttctttgtgaactgttattcattttcagacatgaagaaagtatttctttatcttattttattttatgttccagggtatatgtgtaggatgtgcaggtttgttccataggtaaacatgtgccatgctggtttgctctacctatcgacctatcccctaggtcttaaacccatcatgcattaactatttttcctgatgctcatttcttagtagacatggcacttcaaccattctgaagcttaaaaattatttgttattttaagcccgtaagagcattttaaaatctgatacatctgagcagaaacttttggtttttagtttttttataaattaaatgaaattaacacattaactatttcaagcaaataagatccacttacataaatgaccatgttagtttgagaagttatagcttactgatctgaaaacattaattgaacctccaaaattatacccgtggggtaatttctatcctcgcagcggtgtgcactttaggacaattaaagtgccaaaggaatctcattttatttcttggttattatgtctaggtaaactgatggctcatttttaagatctgtttagtatccaatgattaaaataaaaatgatgacctcatcatgatattcacatagcacatttatccatttctcttttgatttatagcttatttttacctaatgcagtttactcaagtctcctgggcttatacattttttagtctttgataatctatactaatggaccacaagggtagcaatataatctaatgaagtggttaacccagagtcttgggagtgaactattgtggtttgaagcagatcatgtttgtttggcctactttttttttttctttttttttcttttttttgagacagagtttcgctcgtcacccaggatggagtgcaatggcacaatctcggctcactgcaacctcggcctcctgggttcaagtgattctcctgcctcagcctccttagtagctgagattacaggcacctgccaccatgcctggctaattttttgtatttttaatagagatggggtttcaccatgttggccaggctggtctcgaactcttgaccccaggtgatccgcccgcctcggcctcccaaagtgctgggattacaggcatgagccaccgtgcgcggcctgtttagcctacttttatgactgattcacatttattaaatagctcctagctggatggatcattcagaatggcatagatctgagtagagacttggagactattagcagagctagcttctaggaatagaagtagaagtcaaatatttaaaataatcaccgtgaatcaacatttggtattacctgatcattctcaaaaccctgttccctatttaagctttgatagaattatatgttaaatattcagatacgttatgtaaatgacgaccaggacttagaagttgtttattattaccttcctttatgtggctactaagtatttctgtccatgaaaaatgactgaaatcataatgttaaaaataggaaagaggccgggcgcagtggctcacgcttataatcccagcactttgggaggctgaggtgggcggatcacaaagtcaggagatcgagaccatcctggcctacatggtgaaacccccccgtctctaccaaaaatacaaaaattagctgggcgtggtggcacacacctgtagtcccagctactcgggaggctatggcaggagaatcacttgaacccgggaggcggaggttgcagtgagctgagatcacaccactgtactccagcctagcgacagagtgagattccatcttaaaataaaaaaaaggggaagaaaatacacttacacccattcccaggtaaaatgtcacatctctgtttgaaatgctcatttgcatgaatacattatgaattgcagttccaatatatacatttctgaatatggaaacctcaataatattttctctttgtgttttatatttagtactaaaaaagtgatttgtggctaatataacattcaattaaaattaacatttatcctaggggcattccaggtactacagtctgtctcattcattagagcattttgtacttatctgcagagcatctctcctcagaagagaatctgctgaatttttgcatcttatccagcatcaatcactttgattaggatctcactccatgaaccaggcagcttctcttccacagcagttccatatgtctcctacagctgttctactttctaagtggaacgtgactctcttcagctcatagtttgtgtccccatcaaaaaagactgtcaatagctcctttattcttttgatttgctgtactctcttatggcttggaatatgacttatagtcagtattgaattaggatatgttcgattaagagaaattgtgtccatgaatgttttgataagtgaaatatttacatcaaagctcatgctaagaaactatttgaagagcaaagacagagcagaaactttgcttgtgaaggaatttctccagggaaattttcaccgtgcaactcggtggtggaaggctgccataattttggtttatgttaatagaggttaagttgatttttattattttctttggttggtttataatcagcaaattttatcttggaaagtagatttttttttgcccaggtactatgtttgtgtgttagactatggaaagccagaacaactattatacattgactgcaaagataacagaattttgtgtgtgtgtttgaaacttcctttcaacctcaacacccgaaatgtttgctgcaataccttttctatatgaaaaccatagaataaatagaatggaagtaaaactaattcagaataaaagaaactatcatttctacaaatggcaacctcatttatttacacctaaaactatagttttcatagggcttaatgtgaaaagataaaagaagtgaaaaggtccttgagaaaataatagagtattacctgaagcttgctgagcaaacatttttggggaatgacaaaaaaagcttttgaacatgaacttctgggatttcaactgaatgatcaagcatgaagaaacttgattatcctgattaaagaataatgctgggaagtctttgcataatttgataatatttttagtatgagctgatgtctttaaccaaaatagctaccaaaattttagaaaacactatcacaccatgcatgttgtgaatgaaatttttatttactcacttgttgatttgggagagctatatgaacaattattatcaccaatagtattcatggtcttttttaaaaaaagactaacaggtcaaagaaaaggggtttaatggattcccaattttagtatgttgtacccttgagtatcagatgtctctgttcttagcaactttccttgcttgtggaaatctagaaatggtttactcaatgtcagttgatcatgttgttttatctgaaaggcaaaaacactaggatactttcaacttcccatagagaattacacattcaaactaaagtctagttgttcaaatggaaaaatcgagaggcagacaaattaatgtaattatagacttggtagggtgttgcaaatgaataagaaactggcaatttgagtagttaagaaccattgtatattttattatagctgtaatgttttgagttcataaagccatattgaagtaggaatacacacatacactcatttttagtaagcacaatagaagtaagtcatttcattatcattttagggctgattcttacactttttagcccacaattccgtaagttgtctaattcgactgatacagaccagttctagctaccaaaatattatgtgcacaaaactccctttcattctatttttctgatcacaatatccatgcccacaatatagctaattagttaagtgtgggaggaaggcttttgttagaattcttactccaatggattaatcattggaaatcctcaaattgcctgaagttgttagcatattttaaaatcaccagataaatacctaactagaacatcagataatacatgacaattagaattattctagcgagctgtagtcacatctgaaagttaccatattcttgctcctcaaacaccttaaatttaaactctgatgaaatccatctgtaccttctctaatatctccccagatagtcatgaggagtaaataacatactacaaaatgttaaaatatttcaaatacaaagttctatagaaatgttacacagtgctattatcactatttctcaattaaatgtacattttaatattaaatgttactgctaaaattattttgatagtagttatttataaacattcactattagtaatagccaactattatgtatggttactttcacttaggatgaaataaaaaatattggcttatttatatatttcagagtatgttctagattcctataatggggttctaatggggctaaatatgtcaaattcttataatatatattaaatgtgtgactacagcagtgccttttaatgtgggtcttcttttagtatctgaagaaagctaaccaaattttccattgtaaccaccaatatcatatttttaatattagaatataatacttaacaaatacaatagttaaatgtttatttaatactaactaaacattgaacaataattcttaaagagattcacaaactataaaacactataccagactataaggtgcttttactaatcaatttggaaaccataacacctgtctgatgagcatgcttattttaaaatgaacagatgcagggtgtgataatataccagattaaagttatgagtgaatagatttccttgtaattacaagtcatatagtgaaggtatcgatgctatatatatttctgtcaatgaagaaactgtataatttgaagtgttttaattttggggggatgggggacggagttttgctcttgttgcccatgctggagtgcagtggcacgatctcagctcactgcaacctccacctcctaggttcaagtgtttctccagcctcagcctcccaggtagctggtattacaggtgcccaccaccaggcccggctaatttttgtatttttagtggagacagggtttcaccattttggccaggctgctctcaaactcctgacctcaggtcatccgcccacctcggtctcccaaagtgccgggattataggcgtgagccaccgctcctggccacgtgttttacatcttatttataaactagcctttggaaaatgggtaagaactgtagtgctttttgttggtaatactgtgtagttgttctttagttgtcatttcaaaaccaaagctaaactgtttacaaggaaataaaaacttaacctgtgcacaaatttagcattatggatttacatactaccaagtactagaactttttcagtctcaaaaactaagcccttttgaaatttagctatttaatatcaggaattctgaaaacaagggatatgggatgtaaggagaaaattattcctattctatagactttgttatgtatgttttaaaatgtaattaatatcaacgtaatattgtatctttcagacactgacttccatttcctgattggttataggtaatttgaagatttttcactataccagtagagatacaaagtaaaacacaggtatagtctcctagaaaattaaataaaataacccttgagtagacttgtaaggtgacatagaaccagatatgcctgtcttctgttttgctaaaaagaccttgtttccaagtgttattgaaaagtgtcataatgaaatcagaatttaatgttatttgccctggcaaaatcatgtgtaatggtaatcataaatcagttaaggagtaatacaagatgttatgcaaataagcactaaagtttcacaccaggtaaatggctgccttcgtgagtcagtggtgaaatggtaaggttctagaatatggatattgcaatggacattaaaagcaaaatgcgtagagacattttcttaaagtagtaattaatggtacatggaggtgtgcttaatgtgaaggaataataaaagcaataaaatttcaaacaataagcattcatactgatttgatttgtgcttgtataattctctttacaactctatcatatatgttcatctatttattacattttggatgttactgcattcttgtcttagtttattaagcttcccttttaatatttgcctttattttaccctcttctcatattatgatttccttgatcctagcttcttttttcaagtccatgcatcttagtatttcatggctggcatcaggaagttttctaaaattttgtctggttttcatggaaaaaattgcaaagtctcatttattttctaagcttcaagacaagtgtatccatatggattcagaaaatttctataggcaacttctattgttcttttcactgagccttaaattagaagagctgtatgtagacttagtgttaagtacaattattgatgtactgaccttcttctcttatttttcttcataagtggagattgatatacataatctatacctattcccagtaccgacttagcctttacccagcactgctttcctgatggatgtggagttttctccaaataaaactaccatatcttgtaaccatattaaaaagtagaagcattctgtatttatattttaacttaaatatttattataaaaaattctaaatatatacaaaatagagaatgataagtgaagattcatctacctattagcaaatttcaataattataagcattttaccaacctttgtacctattttctatgtaggtgtaatacatggaagtctatatcctcactatgcactgttgtagactcttctctcaacacttctgcttttcctgaagtgcctagctatctgagcatacaatagggctaccaatccatttttgttctccaactatatttttatctgtgatttataatatctgaatgaaagcaggaagagacaagatagaaaggaggaaaaggaaaaaataaaaactataaataagagtgtagtagtttaaaggaaccagggaagtaaatgcctgatttgtggttagtgcagtgctgtatactagagtgaagaaaccttacactcttgacaatatcctggtaattcctgttgagagggcaaaacacgcgtagtccagaactgcatttctttaactgaatcatccccaaaaacttaaggtcgtggaaattctctctaaattttggtgtctggttctgacatatttttaaaattcagtgcttccccaacacctgtaatatgtatattttaacaggtagttggacatggtatttcaggctttcctatttttttcctatgtaaatatgaaagttactctatgggcctatttccctgaaatgttggacccactaacacaatcagactttctacaaactgccacactgattctttgccttcaggtacacctatagaaagatgagtgtgtggggatggcatagacccaaccagcagcaagagggagtcattatttcctacccaagagtagggcagagagaaagaagacacatttgctcagccattaagcataaaccaatgaatgccagactctttatgatcttgccagtcaggattgatccatcctttcatttagaggaggattgagcaagaggtggaaacacacgctagacatatttttctagtataggtcattacaaggaaataccaagatgaagaagacagttcttcctaacaacctctgccatgaaataattactgaccaaatatatttgggaatatgattatgctgaaagggccacatgaagtccttgtttttttattatttacagatttgactattttttttttctattctaatactgtgcttcctgatgctctattataaagaacagaggggattgggaagctggggttcaagccaaagaataaatccatgatgtattttaaagaagttggtagaagaaaagagaacaagtagatttttttgttgttgttttttgtttttgtttttgtttttgtttttgttttgttttgtttctttgagatggagtctcgctctgtcgtccaggctggagtgcagtggcgcgatctcggctcacggcaacctccacctcccgggttcacgccattctcctgcctcagcctcccgagtagctgggactacaggcgcccgccaccacacctggctaattttttatatttttagtagagatggggtttcattgtgttagccaggatggtctcaatctcctgacctcctgttccacctgccttggcctcccacaatgccgggattacaggcgtgagccattgcgcccggccgagaacaaataaatatttatagagtttggtgtagtaatatttttacttactctttcttattctctttattatttgctcctgaggatatgagttaccatctaactagcatcatttccttaagccaatatatctttgttcccttccacctcatttgttttgttgttgtcaaaaatgttatgtaatacataagttataggtcccaaaataaagttatatacatgttgttttatacagttgactttgaaatcaggtgaaggaaattgcctttatacttttttttttttaatatttacataattacctttactccttgtttttctgcaaggattttgcttatggttactttcagtttttgtttgtgtggggatgtctttacttcatcttcatttttaaaagataactttactacatataagattcttggttgatgattttgtttctttcagtactttgagtatgctatcccactgtgatcaccattgtttctgctgagaagtgagctgttggtagttcccttaaagttattgaagttcccttgtaactgataaattgtttttctcttgttgagttaaagattttctctttgtatttggctcttagcatttttcctacaatgtgttaggatgtggatctctttgtgtttattatacttgtagtttgttgagcttcttggttgtgtagattatttttcatcaaatttgaaaagctttcagccgtatttttatgtttctcttcactttctgtccttctgttctgatatgctcattacgtgcatgttgtgtgcttaatggttgcccaactttctgtgaggctctgttaagtttttccattctttttcctctctgttcttctgattgcataatttctattgatttatttcaggtttgctgattctttcttctgtcatttcaaacctactcttgagcccttctagcaaattgttatttcagctattataatttttaactccagaatttcatttggttcttttaaataatttctgcttcttcatcaaaaactccatttgatatagcattgccatcataatttcctttacttctttaaatatggtctcctttattattttgaacatgcttatatggctgctttggattatttgtattaatatattaaacctgacatttggcctctttcacagtcaatttatgttgcttggtttgtttcccgtatatggggaacacttttttctttctttgtgtgtcttttttcttattgaaaaatggacattttagatactttattatagcaactgtggatactgatatcccctaatctggagattgcttttgttgttgtttgcttgttcatttattctgttacataactggactattttagttaaatgtattttcctgacagtatgaagcttgcaatgtccttcctcagaggaggcaaatttgggcatgtgcatagtcactctgggatgacagtggttttaggaagattctctttgactgtatctttccctgatctctctgttaagctgtcttcctctgctggtattagaccaagtttttgtactacattatttgcctgcttattgttttggataatacgttggggtataaattgctccacattctgatccagttaaactcaagcccctttggaagccaattttgctccaaagttcagggcaaggccactggcctacttctcttgaagtgacacctgtgctttatgagcagggtgttgaatagagtctgtagcctctggccttctcagcttatctccctcagcatagaacctctgccctaggaacaagataaggtgagggcagtagaagtgggaggagcacctccagtattctcagcatgcctcacaggagctgaagcccctgccctatgtgcaggaattgggtggaggaggggagctccaattctctcaaatgcactcactagaaatttagcctctgtaacatagagcttcagggcatgacaaatgctggtagcctgctgctcttcagggagagagtcgtctttgtctgggagctggggagagtgttaagtcccacttttttggccacacctgtccagattggagcttccattctgcggtgcagagtggggaggaaggatgtagaccatgtgtaaacgccacagactctccttgttcttactgagatttggtagagtttcttcatttgctgcttgcccttagggaaccttatggagacttgaaatggttgttattgtttgtttgtttgtttttaataattgtcagtaattattgttgtttccttgggagttggactacagagctcatcatactgctgttctggaagtgaaagtactccatgctgtattttaaaggccttctgggatccctgttgcataaagattaaattaagtgttaaatgccactgtacgtttcatgatactagcaagaaaaataaaacaggattttccaaatatccttgattcagactgagaaatagcaaactctcaaaacaaaacattaatgtgttggtgaaatgtgcaaaatgctagcttctcaatcatctttggatgcggaattgcttaagcgaaatgaagaaaaatattccctcattgttaagctacaactgtttcatcattggagtgttccacgaaacagcctatttcataccagttaagggcctagctagaatttcaaatgaatgcaaataagaacgtttgtaatgcaagttgcaaggtgggaggaacaactgtttatgtaattttcctctcttttcaactttcacagagcattgcataatgttagaatcagactgcttgtattttaatcctggcttcatcactaagagatgtaggcttttgaccagttaatctaggtttcagtttcccattaaaaaatagaagtagtacaggacctacttgtaggtttattataaggagcataaataattgatcacttgggtaaagtgttaagcaattccccaatgtataaataataaatttaagatggtaataaaattaaaaaatcacaaaagcattaaataaatattatctctttagcagcttggcataatcagtagaaatttgagttctacaaaacttattgctgaatgaggtatagatttggatattagacaagaattttttaatggtccttatattcattggttttaatttagtgggtttccttaagcttaatgtatctctagtatgatcatctccacaagaatagataatactttttattaaatgctagcttagtccacaaaactttgttttattaaagtagataaattaagcaatgaaactattgatacaagatgtctttatatctttcactccaatcagttacatagctttaaaactcagaattatttttgtgtacatccactgtgtagtacctgaagtgagatgaacttttatgctatgctttttttctatttggtattcattgagtagcttttaaccaatctccttcttctattatacgagttgctctactgggcttttgggatgcagaaatgagtgagaagtggtttcttcagccaaaaccagatagccatttaagcacacaaataggatacatttttagaggtactattggagagatacctacaaggcgttgcagaaacacaaaaaacaaagagtccctggaggtatagggaaaagcttcaaagaggacacgaaggtgaagtcatttgagattgattatataacctagtgaagaattttccaggtacagagagatgcaggaagaccatttctggcacagggaacagcagatacaagagcatgaaataattaaagtactgtgttgttcaagagatgctgaaaagttcagatatttggaaagttcagtgaatgggatgcggaaggataacggaataggatagaaggggcaggttgaagccagatgtaaagaacttttatgccttttttaagagttcaggcttcattctttaggcaaaggcaagccagaaaggattttaaccagtaggagtgacatggtcagttaggtctttagaacaataactctggcttcattgtgaatgattgaagggcatggtgcttatatttccattgtaatagtctaggtcagagtaagtcagagctgaattaaaaatagctggatacaaaacagcttttctcttccatgcaatagtgtgtttcctccctaagccccactctctcccagcgaatacagttagtcttgttttatgaaaccagttaagttattaagattcaagcacccagctttctttgcttagctagctcaggtaaattgctttaatgatgtccatactgtaagggaagcatattctaatatgggaaaaatggatcagatgtctttgaaattatcctttttagtgcaatgaggaaattgaagtgcatagtgaaatgttttgaaatgttgttaataatgatattatctactaccgacatgctgtaatatccatttaaaagaaataaagttaattttgtatttttctgctctaacaatgaggaaaaatggtaaatatttgggaacgtaatcgaatgtggaggttgtcataaagtgagttatttttttccaaaggactgtaatgggaaaaatacataagtgcatacatatggaaatgacttgatttggtagttgagatttatatgtgacttttaaaaatgatttccagttgctattcctaatccattattttgttgtcttgagctgcagattgttgtctaggtcactaaatggcacactaaacacatttgctcaccatgcccctgtttcttcagatcttttcctatagaacacacacacacacacacacacacacacacacacacacacacccctccccttcacagtttttatattttcagagaaatctatgcatgatcttctgtcatgcaatcctatcaaacatccaattcttttaaacagctaattttttatttcttacttttgttcccaagatgtaaggcacttgtaagattgttctcctttcctgaatattagcaacaacagccccaccagccgttgcagattctgccatcaagttaacacatggggtgtgtagatttacaagtaggaatgaaattatattagagataatagctcttacattgctcaagaatagatcaccccatgaccacctggtcctatatcagttcatttctcttataattcaggaattagttaatgtttttggattgcacgggatgtgaaacatgcctagaagctttgccttatatgggaatctcttaaaatttatgaattcttatatcaaggaaatttttaaaaatgcttaatattacaaaacacaattctgttctttatattatcatatttgcttaaaacctttaggatccaaagaagtgtttttcattttgacatcctactttggttttaattgtcatgagcactagaatgatatgtattgcttccaaactgagtagattctattcgctagcttatgctgtacttagcgagccgtcatttgtcttaactgtatgaaccttagagtgtttataatttacttagaagcagcagatatcagcgccctaattaacaccttcaccattcctctcctggtacttgagaagttggcggcactacaaatggaacagaggctctgaaactaaacacggacctgacacaggatggacatcaattgtctttcatggccttgaggttcttccaattttattttgtgcaataattcccctggatcctgatttctatctcccagtgccatgttttcccacattgttcattgcccaaacctgatacatcatgcaccaaaattaggaagttgacacaagtctggatctcctagtatacgtaatgtggaatgaagatttgattagtaaagggaagtaaagatatgcaaaaaccacagaattattaatattttttcctgtacacttctatagtctggcaaaaaaaggtttggaaatttctaaagatagtagaaaatggactataaatgacttgtatacagaaaaaaagtgtttcaaaatattgattcatgaggttaataatagcttaatattaaagcatttatttgtgtcttttcttacatatctaaccatattgcacaaaaaacagggtcctagaattctatacagaatattacatatctatatcagacatgatcagaaatcagtatcagtacataaaatatactttatattacttaaatggaagaatttaaaatgatattaccatgtaattgaacagatttgaggtgcctgaagattgaaaaagaaataattattttcagatcttgagaaattctacaaggtaatcctgttgaagtcttcatcataagtgagttttccatttgtattattagtgtttgtattttttgttgtgagaaagcgatcctgattctgcttattttaacaaagacgagaataaatatatcagaaggtcattgggtcaggcaaagagttgtttgtttttcaacataggccacaaggatgaacaggaaaaggacatttctagaatgtactgttacagttttatgaaagtaattcaagcaaacaaaacagcaaaaagacatagctgccatttctcagtgttctagggaccaaagaatgtacttacagtgctaggatgtctgcatctttccagctctcacaactaaaataattcaagtatttatgccattattttaaattttgttattactgcccttgcctagatcttcattttcactcaattgaaatagtatgggaaattcctaagtgggatgcaaaccttcagtctttccaacaggattgtaataatctcctggctggactgtactgagtttatcttcttatcccctatagtatctagcacagagaaggaaagtgtgtgggaaatgcaaccacgccccttttcttcctttatgacagatggttttaatagattctagcattcttttcctcacaagtctcagcataacatgctgatttatcagagttggcacatgtcataaaatctacttaccatttctgaactgataatacttagtaggcctaaataaatgtttatcgaactaaagtattgcacatacccagaaatggaactgggaggataagtgaaaagaaattcttaaagaattatttcatagtttttctatttctattcctaaagctccccttttgtttccattgccttcagcggcaatggaagacttacaagagacaagtgctaggtctcatcaacttgagagtctgttcattattagtctcttctttgctcccagctgacttatatttaaatatatggcttccatccaatgattcccagcagggccattaaataaagtatgtattatggacaaaaaatggcaaaaatgtacttggctcagggacacacctttctccagtgacttggattcctttactcattaaggaaaaaaaaaaaatggttctatcgactcgtcattgttgttttatatcagcatgtcttaaccataggaggaaaaaggcagttacagttttaataatgaatcttaaattactggcacttcactcataaatgaagaaaggacagtataatattttattctcagaaacttttctcatctcccctttcctgggtcgtgaggtcaactaattttgattttatctgctctaaactcatcctaatcctataacttagtcacgttggttttaatatttgaagattgttttgtttcttgagattttcctacttctctctaaaattgcatctggggcatggagaaatggctttcatgacattgtgtagttgagaggaaatggatcccctcacctcctgctggttcttgggggattggtgacaggatttatctatgggatggtctttagcatatgctaattgaagttgacacttggtaaaattcatagtctaaattatctcagcttggttaaggcctcagaaagatccctagcttgttcatccactctaaactctaaactctgagagtgtctgctttgcctttcatctttctcctggtacaggctatccctttatttcaaggttgctagaccttcttttagaccttctttacagtggggtcagtggctaatctgcaaaacccgaggaaggcctgggagggcaaactagaccatctctctggctaatcatgccagtctgcttcataagctctgcgttttcacacaagactgtgctttcacagtcaccctgcacagcagccttgtgctagtgttcaaaatggcaacagaaacgtcctatttcctacaatttatggaacatatttcctcctctccactaaagcatgagggagggaagtggagatatgtatctccctcacctatatctgcctccagtccttttcctgtgagccttgaggaaaaagaaataaatcatattcttaagttttcaaaaatcttaatcatattacattatcagtagataatagaaattatagaaattttattaaactttttctttgtggtatctataaccttaatctcttcactctcactaaatcttcaatctgttatgtttgatgtattgcaatagtttttaacttgcttcttgcctccttttctctttccactccaggctattttgcatcctgttgccagactattcttcagctctctcgctttgattacaccgtttttcattaagacatttagaattttgtctcatcatttatctattattctttttcaatcatatgcctgctgagtcctaagactcttttcttcttattataatttctttactacattacccctaaatttgttccttcctcgtttctttatcatattaccttgtaatgataagacatccatatactgtctgattcttcaaagcctagctttagaccctcttgggtgaacctgactcactccataactagagtatttagtctgtagaacatatcttgatatgacattatgagtttgagtaggtattctctcttttcttcatatttatctttcccactaactcttttatttttttaaaaataatcttcccaacaacccttcagtgtgggtgttgatatctgcaaattacagacaagaaaactgaggttcagaaaagtgaagtcacctgcctaaagccacaaaactagttgatttttggagctgtgattcagatccaaatctggtttcagttttaagttcctcactggattaggctgcctcttcttaacagaaggggttttacagtatattttgagggatacttcacaaataaggtgatgtttgagggggcaatttattgattactaaatgctgaacacagtatatcatgttatcctttcaacaactctgagagttaggtgctaccaacagtctcgatttttcagttatggaaggtgagtgatagagggaatgcaggggctaaataatgaattgaacacaaggccctaatcatcatactgctctacttcccacttattgaactcaattctacacatcagacccttctcaatctagtttctgggctctggaggttgtggcgatggatggcctagcatttcctaggatctaagccctgggcatagcctgcttccaacattgggagcatagagatgagtcaggaaagcctgaccatggcctaactcatttttaagcatcttaaacaaagaatagtgtttagtatttgtccacggttattataatgtctaataggtggtacagagcactaaatatttacttcattatacaaaatctaataggacttaaaaaataaaagcacgtactgcaaaacacaggtttgaacaataagaatattgcttttttgctgttctttagacttcttttccatgttttcattaataagcatgtattattcttataatttacatctgtgttagttcaacaatactgtaatttaattacattgtgatccaaacaattagactgtgacattttatttaccaaacattactaagtctgcagttaatcataaagcagtatttctggtgttcatctccaaacattttatctacattattaacttagaatatttgcaacatgctgcttctcaactgtgactatgattattcacttatatttgtatttcatcattaaaaagaagccctcattttctcattattaggtcttaaactgaatcaacctgacatgaatataaaaaaattagagtagtttaaaacagttggttcatcagagatttgaactgaggtaaacaaaattaggtagattctgtaaataatcaaggcattttattttaattaatggccttgttacagttctgtttcaaaaactgaaggatttggatattacacccccttaggttttatatacatataatgacaacgttggtttggatgacgtctttgttctttctagctgttacattacattctgtagttatctgaactgcttgccagactgtttagggaaatgcatgtatcacagttaggggggattcacaaatggtaggtttctctgcaaaattgagacatatttagagtagaaaacactttgcctcttggaaatagaagtatagggtaatctctttttgtttgtaggccagaagtttctgtggactataaatagaaacagctcacagctaggatggagaaagctagagaaatgtacctatttgattgaaagggatagctaatgtactcaaaaattgctcttgagaaagagcaatgacacattcattctgaaggactacttaattgcccactcttggaacaagttggtcttcagctctaaactaaactgaagattttgaaaatgatagaaaaatagtgcagcaaatgttaaatttatgaaataggcttgcaattttctcatcaaacttagaccaaccttaacgatattgtaagagtaatatattctcaaggataaaatgttctctagttcaacttctacatagaaaatgagtttaaatgagccagtcgtcttaatatttggatacaatggtcattttgaaatatgtgaaatgtgttccactattattagaaaggaaaaaaaataaatatgcttatctttgatttgggcaatacccaggactgattcatagaaaaaaatctaatatatttatacataggagtgctttctctctacttgtacctacaataaaaaggtcgtcgtttgctttttaaaaattattttcactggagtatacttgaaactgtacatctcaaatgttttaacaaatatacctaaatattaaaattactaagtaattttgtccattgaaaaatgtggctactgcatatataataagacatagtttcttctcaaaagtgcctaataagactaaagagagtgaatcaatggaattatttatttgttaaaatcatgttaaatgtcttaaaggtgttattctttctttcctaattttcaaaagaaaatactttgtcttctttcatactcattgtttctaactctttctaacttttagtaattgtcaataacacttatattacttaaaatcttttccttaatttatcttcttctacccttctatccaactcttctttattaaaaacatgtcttcaggataccacaggagaaaaggtcagaaaaagaaaagggagttttagtgtatacctacctccaaacagtcattattactgtcaaggcataaagccatatgttgcatatgacaaattctgtatttctactggggtgcattgtactgtattttcataacatatgccaggcaacttctatgtatttcaggtcactaagtatacttttcaacaagacaaggaaactttctccctcccatcccttctgaaatctttatttggagatctagctctaagttttatgttttcctggtggtctttcgattcattccattccattccattccattcattcattcattcattcaaaaacattattattcacataccataggtcataaacctcattacttatgggaaatacgaaaatacttaccattctgtcttctctcttctttgaggcttgttctcatgaaataagacagatctatctatctgtctgtctgtctgtctgtctgtctatctatctatctatctatctatctatctaaacaatgaagtgatagattaagtatatgaaaggaaaatgaaaagcaaagaaaaaaggaaaaaggcctctgctagttgcgttgtggatttggaaaaacttcatggatgagatgatcctaaaagattactctgggtattccatgcagctaaaggtcgagggccaaggtggctgtaatagtccaagtaatgtggaaagaatttgggtgtgaaaagacttgccaggaagttttgactccagaaagattctaaaataaattggtaattataaagatgataatgtatggcctcgaaggccatgttcaggaatttggactgtgtacagacagattgtggaaagctattgcacgattttgggcagttacacaataaggttattctattggggagtacacagatttggctgggtgaaaaaggctagcagagaaaaaggccattttgaaagctgttggaaatagtcctgtgagaaataataagaaaacctatcaaataggccaggcacggtggctcacgcttgtaatcccagcactttgggaggccaaggtgagcagatcatgaggtcaggagttcaagaccagcctggtcagcatggtgaaaccccatctctactaaaaatacaaaaattacctgggcatggtggtgtgcacctgtaatcccagctactcaggaggctgaggtcggagaatcgcttaaacccaggaggcagaggttgcagtgagccgagattgtgccactgcactccagcctgggcaacagaaaaagactctgtctcaaaaagaaaaaaaaaaaaaagaaaaagaaaaccgaaaacctaccaaataagtggagataaaataaagaataagaagcataccagactatagtgagagcatatgaaagccaatttgatggttgaaggagaaaacattcagtattagaacaatcacaagacacggcaaatctaggggggaatactgtttagttagaggcatgttgcctttgaagtgcctgagttgagaaacattggacatttagaaagtgagggtggtggtcataaatctgggagtcccagagaggtagactgatccatgggattgtctaagttgggagtgggaagagagcatcttgataaagaagaaaagccacgctacaagactagagaaaatcaacataaagaacaacaggcggcccagcacggtggctcgtgcctgtaatcccagcactttgggaggccgaggcaggcggatcacctgaggtcgggaccagcctagctaacatggtgaaactccgtgtctactaaaaatacaaaaaaattagcccagtgtggtagcgcacgcctgtaatcccagctactcgggaagctgaggcaagagaatcacttgaacctgggaggtggaggttgcattgaggcaagatcgtgccattgcactcctttgcactccagcctgggcaacaagaacaaaattccatctcaaacaaaacaaaacaaaaaaaacaaaaacaaaaacaaaaaacaaaaagcaaagagagaggtttgtcaatcacagtttaaaaaattaaggcaactgggataagcaactaatatttcagccatttgagaatgactctatctcttcgtacacttgcaaatagaattgtaatcacatgagatttcaaccagataaatttggttacccagaaaaaaatgaggtcatgacatagatttgaaggccaacaaaaattacataatcagtgctccgtaaattagctattacgtaggtggatgcacattttgtttcatgtccatgaagattcgaagcgttaagttattttactcatgataacaatctacttcctatcgaaatttcatggagagataatagatcagtatttattctatactgagtatagaccatgaagattaaaaatagctcatgaataagggaaagggaaactctatatgtgggattttatgtaattatggtaacaattccttggagatattgtggtctgttatgtaaatatgtgtaattatgataatttcaaaaaccatgttatttactcagtagtttaacagctccttcacaaagcagtcactttcagaactcaggaggggtatagcaatactttccataaaaatgaggtaaacttaacatctcatgtgaatttaaaatatatttttataagaaagacatcagaatttaagggtatatttaccccatttttactttcacacaataaagtactgctgtagcacagatcattattacccaagttcagggatgacatacacaaagattattattgataaataatcagaatgaattggtagtatttgcatagatttttctggaccatagttgtttttacctgttgtttgagggcctattatggggggcatatttaatatatgagtgctataactagaaattcaaactgtcagagggaaggaaaccatccatctacccattcattaaatgaatatttattcaaggccaagatgtgctaaatgtgggactgaattttgggaccaaaatcttaaatgatgcatatgtcctactattacatgctgtctaacaggcagaggtaatcaggtaaataagtcagtgaaataacatcattggagtcttcacatttcacttttccgggggacaccattcccattgttgtgaaatgcaaagaccctgagtgttctaggtgttataatagaaagaaaagtagggtacaaaaggggaacaattttatatggtagagctaaggtcacttaggatgatccaagttttaatgtctccactagacagccagagtaataggtgaatgtgtgtgtgattaagaaaaatcatccattgccactcattgatatgtaagggacaagcagaggaggggaagcactatcagaggagaatgagaaggaatagttaaggcagaaaagaaaaaaagtgaaaagtacatttttttctgaatgtaagattccagaaggcagtcggtaaaagttccaagagatccacggaagtcaagtaaaatgagagggaagagtccattggatttgaaaattaagtcatgagcaacttcacttagagcatgttcagtaaagacatacaaataaataaaagtgactttgatgataacttttggttggcaacaccaacaaaccaattttgaataattcctccaagaaccgtcatagtgaaggaaaacggagtggtgttcctattctaggaaaggtttttgtttgttctattttggttttgttcttggattttttttagttttagtttcctgtggtattaaaacatgtttatataaagtaaagggggctgggcacagtgtctcacccctgtaatcccagcacttttaggaggcggagacagaaggattacttgagcccgggagttcaagacaagcctgggcgacaaagtgagaccccatctctacaaaaaattagttgaccgtggtggtgcatgcctgtgatcccaagtacatgcgaggctgaggtgggaggatcacttgagcccggaagattgaggttgcagtgagccgtatttgtgccactgcactccagcatgagtgacagaacaagaccccgtctcaaataaataaataaataaacaaaaataaaaacaaaaaaataaaaaagggaagaatggttatatatggtaaaccaggactcctcaagaaagggagaaattagattcagaccaaagaaggagtaagtggctttaatctatgaacaagataaagggttcatccttatctgaagcaggaaagaggaagggaaagagagaaggatggattctaatataaatacatgcagaaagttcttaaccatatttttcacttagaatcacaaaaaaaagacatataaaacaaagtcactaaagaacataataatgtgcttatattacactgaaatgatactctactttcctctaattattattcttccaagcaaatacttttttttttttttttgacacagtatctcactctgtcatccaggctggagggcagtggcgtgattttggctcgctgcaacctcccactcctgggctcaagcaatcctcccacctcagcgtttgtagtggctgggactacaggagcccattaccacatccagctattttttttaaatattttttctttctttctttctttctttctttctttctttctttctttctttctttctttctttctttctttctttctctctctctctctctctctctctctttcttttcttttcttttcttttcttttcttttcttttctttctttttttttgatggagttttgctcttgttgcccaggctggagtgcagtggtgcaatctaggctcactgcaacctctgcttcccgggttcaagcgattctcctgcctcggcctcctgagtagctgggattacaggcatgtgccaccacacctggctaatttttgcgtatttttagtagagatgggatttctccatgttggtcaggctggtcttgaactcccgacctcaggtgatccacccgcctcggccccccaaagtgctaggattataggcgtgagccaccgtgcccagacacacacccagctaatttttgtatgttttgtagagatggggttttgccatgttgccctggctggcctcaaactcctgggctcaagcgatctgcccacctcagcctcccaaagtactgggattacaggcatgagccaccacgcccagcctcaaatacttttttgacccgaatatcctgcctaattgtgtaagagttaatctatattgtccaaagtaccagtaaggtttttcttcttaggcaaggatgttagaaacatattaggtttttctgatcaatatggctcactttttaagaggaaattgttaatatttttgagtcattgactgcctttgtgctgtttcagagaatgtacaagagtgcggcaataaaaaatggcatacgtattgaaaatattattgctctggttttcagttatttagctcaggttttagaagtttcatctgcctggaaatattttcaaacatccatctatattattgccatgtgagtagtggatctagtgtgacattgcctcttctactggcaatgatatggcataactctagtttgaggagtcaaaataggaggtagcagatctattgtgaatatccaaagtgcagactgcctgttcataacaaattctcttatgaaattatacctttgtaagagcttccataatatatatcttatagagaaactcccaaatggaatttctctaacagactttgccaaactttgatttcttggttaccgggctatagttaatgtgttcataatagcatattgctaacacaaccattaacatgacccttgaaaaataaaatttgatttcacaatgtcacagccgtacatggaattttgaaactaagtcttcttataaaatcattttgagaggtagtttatttctaagtgaaggttacttgtaaataatggtataaccattagcttttgacttttaccacaatattgttggctagtcataatgttcccattcataaaggataactgtgtaatcatttgttattcagatgttgtgccaaaaatccaaaataacatttattcttatttctaaaagtatcagaacatttacaatgaagctgcagttgttttttggtttttgagtgaaatatacaaccaataaacaggataggattacagtatattctgataaaaagctaatttggggcaaatgagccatattacagttgttacctatcacttgattgaaaccaaatcattatctagctttggataaccatgcaccttaaattgaaaattctacaacccattctatggcatacttctgaaaggctctggagtttctctagatgaaatcaaacacccaaagaacatgaaattttggtcagttttcttttacgtgcacatgaaatcatgttctgtcaagtgtgaagattgcggcaggtgttatgagtcagcacacagcataagcaaagctgtatgattgtctacctaatgttctcacgatgatgtttctgcatagttatggaaataaatgtctgtctgaatttttagagcttcatcaccacttatctgaggctaaggtaaatccaaggaggatgtaacatctttttctttacatttttgactatatatatatatttcttttaaaagttagcaattaagccatttctatgtgcctaacacagtgctaaatccttgatagctgtggaaaaatagctgtcataaatcactgtccttgtatttgtggatgctggtatataattttctgtagaaaggtttctgatttgtatttactttcatggaaatcagtgacaggaaactggaaagtatgtagggggtggaaagatcatttgagaatgatgcaaatattgtttgaaaaacttgtatttatatttgtatgctctggagatgcatatatccaaatttaacctcatgaaaattccaggaactaaaaccttgaagaccagaagatgcataatctccttaacaaacaggcttgtttcacatcagcaagctatgatattaaaagggtcagcctatctcaatttgattgaccaaattagaaacctatttaggatgcaattataatgcataagagatcactgtgctctaataaatcctgaaacacatttcatggccagcaccaaggtaaggggctgcccaagttaaatatagaaacatgtactgtgaagggtcagaagtttgcttcttggcatgcttttattcagcactccatgattatgcagtagtggccagtgtggtgtggactttgaggacttgccttaccaccaactagccaagtgagcttggaaagaccccttgaactgttctgttactgcaatgatctatgagacaatagatttgaactaaatcattcctaatagtcttaatgaatagcagtttcattagtttagtaatgggataatactaaagaaaataaaaaccccaacctttgttaggtacatagagtatagtaaagtgattcagataaaggttatatacagagaacaaactaagaattttttttaagaagtaattgacaaaaattgtgtgaaggcaaagagagctaccagtataaaaaccattccaggtagtgtttgtgtcttcagagagaaagaaaagagaccagacaggtctggttaggatattgttggggaataggtagccaagcaactgcatgaaaagccaccaaagggagccttcttcaaagggatgggcgcatcactgagataatccctggcttagcctttgacaggcttgcatctcagcattcacttctgtttgagctattatgtgctgacttcagcatgggagcaatgaaattggggcatgactacacatttcattaccgactcccaagccctgggaaaataatacttttttaaaaaccctgtacctaccatctaataaggtaatagtcaagttgtcttattagattattcattaatgaaacaaatctgtgatgaaacagacttcagatgaatatagctgtaatttttttatcaatgacataaaactgacctgctaaaacagtatagcaactggtaaaatagtttattaaattcttttaaaatatgaccagttacattatatagaaataactggactgtggtccctaaaaaaagagaaatctgcttaggaaaaatgtaattaaaggcgacaaaagaattggactgtcttactcaatgtaaaacttttaaatcaatcttattattttaggagattcatacatgaggactgttgcttttgtattagcttaacaagcacccagggagtcctcctaatagttaagtttatagaattaaaagaagtagggctaatgtgggcttattttcctaatgtgcaacattatttggtattccaaaaaaagtacgtgatcatttattcttttctttgacagagtttcagtcttgtcgcccaggctggagtgcagtggtgccatcttggctcactgcaacctctgcctccccgcttcaagcgattctcctgcctcagcctcccgagtagctgggattacaggcacctgccaccatacctggctaattttttgtatttttagtagagacggggtttcgccatgttgggcaggctggtcccgaactcctgacctcaggtgatccacctgcctcggcctcccaaagtgctgggattacaggtgtgagccactgcgcccagccgcatttattcttttaataagcatatattgaaattccactcaaattaaagggatacatatgtaaataaggactctgcactgagaaggttaactttagtggtgatccaatagaattctattagaatagactaatggatttatataatgatagtacataataataaaactaacaaatatataataaagtataatattatattctagagaatttggaggaattttatctagataagccagatatattttggtcagttgtgagaaagagtgaaattaaaagtaaacagctgggaatagtgcatattaaaaagctgtagcaacagtagtggtgataatggtgatgactgtgatcatgagaaaaagaaaagaagatagaggaggaggaaaaggagaggaatgctagctaaccctgtagatcttactgtgtgctagacatttttctaagagggtttttatatatgaacgagttaatcctcacagcaatcttttgaagtatatgctattattggtcccattttacagttagggaaactcagatacagaggatttagcttgcccaagatcacatagtaagtgtataattgcttttaaaatcagagcatacccattaaatataaaggtaaatattccagagaaagtctgaaaatgttgacagtttatatcactcaaatatctaccgtagccaaatagaaatgtgtataaaatagggcataagaaggagtggtgggcacgatagcaaattggagagcatggatgataaactggagagctacagcccagctaaacatggctagtgaactacaattgttgtggcccgctagaaatgctgtctccgtgttatcagatcatccaagtttggaaaggatctgaaatctggattcataagtgaaacctccaggttattaaatatttggcatttaattaatttttaagataaaatgttagtgggcttgagaaaacacatcagtcactgtgtttgatatatcctgagagccaccagttcatcattccatcattatacagaggcatttattgacttttcccaaatgtctaataatctgaactcagaacgaaatatgtagtagctaaaagtcactttccctcaataataaatattgcttatagcttagtgggttgatttcagtgctaagatattcatttgaagaataaacacaggaacatgtgaaaatcaaagtctagcaacctattttcagtttgttgctttagcttttcagctccaacattgtgagcatccctacgtttagtctgaataacttctcatggactgtggctgtcttattttatgtctctaataccagattatgaaaatcacagaaaaaaggaaaaaatattatttccaaagagtaagttatgaagccatgttagaaacccatatgacaatatgaatttcttttatctgtcaatctcaaggtagaattcctcatatttctgataatgccaaataccatgaaatgtctcaaaaaagacttgactttatataccagttgtttgtcttgctgcctcacttcttcctttcttttctttctcccttttatctgcacccaagttatttctattctgtgttttattggttcttaatatattattatccttgatctctagtcctatcataacttcattttttgtaccaaatgttgctttgtaacatagagaacttaaatgccaatcacctattaacaagctaataaatgtcctggctagaagtgtcataaatggtgaagggtcttgacacaataccatgtgaggattacttaaatagattagggaaataaataatatgtagggaaaatataatagctatgctgaaatatttggaagattggcaatgaagaagctatagtgtttggctagtttgaaaatttattctgacttggaacgtgtggaagctatgagaggtagagtttagtttaacaagtgaaaatatctcttcataaagagattaacctaaaaagtataatggatacctcaaaaaatagtatgttatagagaaagttccagaattgtcaggcagaaatagttaacctctgaatctgtgctctgtctccagaaatctagacagaagctattaagtaatattatcatttaagatgatttttatgacatgacagaggacattatttaaaaattttttttttttttttttttttgagacggagccttgctctgtcgccaggctggagtgcagtggcacaatctcggctcactgcaacctacgcctcctgggttcaagcgattttcctgcctcagcctcccaagtagcttggaccacaggcgcatgccaccatacccagctaatttttgtatttttagtagagacggggtttcaccatgttggccaggctggtctggatctcttgacctcgtgatctgcccgcctcggcctcccaaagtgctgtgattacaggcatgagccaccgtgcctggccagccagaggacattattttatcgacagcaactacaaacattgaaagagactacaacataaactgttattattagagaccaagggtttgttgctagataagaatatgaataaataccatattctcttgtattgagcttgtttttcaataagtcactgaacaacaataattaagcaatgaagccaatacatctagagaaaaaatttaagaaaacatcacaatgtttcaataactatttccatctatacatatttcacacattataaaataatcagttatatcacatggttttatttttaagttcaaaaagtcttcataggctgagctcaatggctcacacctgtaatcctagaacttgggaggccaaggccaaggcaggtgtgcttgagcccaggagttgagaccggcctgggcaacatggcaaaaccccgtctctacaaaaaatacaaaaattaaggcatggtagcatgtgcctgtagccccagctattcaggaggctgaagtggaagggtcacttgagccccatggatgttgaggctgcagtgagccatgattgtgccacttcacactaacctgggtgacagaacgagatcctgtctcaacaacaacaacaaatgtcttcatagcactttctccctactcgagtcttccataaagctgttgaaacacatgcacattatatctgttttttagcactctatctggtaatagtttgtcaaatacgtgctggactcactattttaacccatatttaacccaaggttgtggcaattatcaaagaaaatcaagcaacattactgaacaaaaaaatattttctatgttgaattatgtagttaatgttccatcttctctttgctttcctatccaggtctagctttaggtacattacaaagtgaactgggaagaaaatgctgacatttaagtggttcttgttgcatgtttacattaagaaataataaggccgggcgtggtggctcatgcctgtaatcccagcactttgggaggccaaggagggcaaatcacctgaggtcaagagttcaagaccagcctggccaacatggtgaaaccctgtctctactaaaaatacaaaaattagccgggcatggtggtatgtgcctgtaatcccagctacttgggaggctgagccaggagaattgcttgaacccaggaggcggaggttgcagtgagccgacatgcgccattgtactccagcatgggcaagagtgacactccttctcaaaaaaaaaaaaaaaaaaaaaaagaaaagaaaaatgcactactgtagaatatcttaataattgtcttcagaataagtagattttaaataactacgaactaacacatagtgctttgcaagtgaagtggaaataaattcttaaacaattatatttaatgcaaaaaagaattataaaaaatccctataaagaaaataatgtagactgcattataatcttagtctgtggccctgaaaattttagtcactaccattagtctctacagacttaaccatgtcatgcttcagtgttcgccagttgtcaagaaaaaaatgtttcctggagaaaatgagaacagtcctacctttaagcaaattgattttgatgccttttgtcctagaaatgcacttgtactttattaatgttcttatgtggatcattttgttttgctggtgattttttcaggtaattctgcatgagggagacagcagtaaagaggggagtagtaaagagggaagatgtagaaaaaacactgctggatttagggtagacatagcttgaattactcaaaagcatattccccttcagctttattgagatatgattgatgaataaaaaagtatacatttatggtgcactacatgatgattttatatgcatatacattgcaaaatggttactaccatcaagctaattaacatactcatcaccttacatagttaacttttttttggtggagaggacatgtaagatctactctttttttgtagtctacagtttataattatacaaaacagtgttaactgtagtcatcatgctgtccatcagaattcaagaacttatttatcatataaccgaaagtttgtaccctttgatatttcactgtcttttttcagcatgtttttaatatgtttgtacctttttttttatttcatattttgtgattcctcttcaatctctttgcttttactctacaggtttggcttaggggaagtgtggagatgttggtcaaaagtgtattttgatttaagtttgaaatctttccctctattttccttatggtcgtcgttcgtttttctacatgaaagcagagaaatatgaatatatatatatatatatatatatatatatatatatatgtgcatacacagacacacatgtatatgaatgacacttttttgcattccctgttttgcccaaagctgatagtgaactgttatgttagaatatgagatgaaacatctgattcaggtcagcatgctcaaaacaaattgtagggcttcatttcctgaagtctttttcttattcatttcatcccagagaaatagaagccctctcatagcttaaatttgaagcctaggtgtcaacagaaccggtcactatgaaagtacaactgtaattaagtggtctgcaggtcatctcaacattactgcattgtataatgttctggggtgcatatctcaagctctttatttctgtttcttccctacacctatgtcagctttttcactgtgcaataataactcctatttatcagtaaaatagatgttttaaaacatgatattcttaaagctagtttgacaacttaaaaatagggaaatatgttaaacagatatgtttttaaattttccgtacgtttccttttatttgcctactccccactattgtagattatttaaaactgccctctgtccaaattgtatccttttggagaaagcattttaagtaggagaatccattaaacgcttttttctaaagctcaaactgagaggaaaacttttacatttaattaatgagaattcagctctttaaaagtttgatgacttttcaaacttatataatctgattccatctctggggaggaaaaaagacattttggttttattaaagaagaaatgaccaaaaacattgaccacacgtttgctgttaaagataaccgtacttaattcaacagaaatgggtttttcaccgagtctaaatgacctgcagcattatagaattggctgccattctctctcagtcagaaatcaggctgtggaaagccagaactcttctctacatctagtacaaagattgtgcttagggtttaaataaaatgaaaagaataaggtggaaaattagaatatgttgaaggttgaaagatttgattctgtgacttttacataactcaggaaggaaataacccaattcctctccacatttagtgaaaaagcaactcaaaaccatagaggctgagaactttctctgcatggcttttcaaacgatttatataaagatgttggagaaattcacaaagacctggataatgttggaaaatcttgtgttttgaagacaggacagagctgtatgatgcaacaatgccatctattggcttccaaggaatggcactgaccacagctagtttgtagtgtctggaaaaggaagagattatcagtttggaacatgtgaatataaacttattaatgaactagatgctatctttcgtattctttactcctgaatgtggaactatacatgatgcatataccacacacatataaacataatgcatagagatatgctcacctgcatcttcaacaatcctctccttgatgctagaagatgagcttgccttatcatcatactgatacagtagctgggttttgtcttcctgtggactagtagttgtcatacaagaggatgtgtttttaccagaactctttattcagggtgttactcatgtcttagtctcccctgctctgctaatcccaactgttactgtaatttctaagcacactcagacaaaaacgtacaggactggggcttctctcagttgagccaaatcaattctacttccagatattgcaatccagagtttgatagagaatttttggctgctttgaggaaagaataaaacatttgattgtgactgtcttagtttccttgtttgccctttaagttcattaaaagatacgtcctataagagtcagttgtgaaacctgtgcaatcatttgaaatgagagtatagatttaaaaataaatacatgcctgatatttacatgtgatttagaaaatatacagggagtacacatattatttcaaataatattaatactaagaggctcagaagtgccataacctaaaaacaataaagacatcaaaattgtttccctaaaatggaactagaagttaataaagcaatagttccaaaaactttttgtttttaaatattgagaaaatacaaaacaataaggattttgttgggcaataaattgggaggcattttcccctgattttcttaaagatggtcaaaaaaagtaaaataaaataataggttcccaaaattcttccattgtatgtagtttttaggttgatggttgcacatgtgtagtatagtttttgaacaaccattgcaaataaaaaatctgtgctaaaaataacctttttatttaataactcccttctcattttcatcaatttgatcacttgctttaattcatgggggttctaggtggcacttcaactgactgctactgattagtaatttaactaattgattgtcaaattgtaattattgctatgcagcataagtgtttacttgaggatagtaaggagtagccaagtctttcttatttaaaacacttacactaataagactctagtcaaacaaacatatttatttgaatactgtggctcatttgaaagcagaattaagttataaaacaataacccattgtattgtttctgctttctgagtaaaaacaaaatagcacactgtttcccaaacttaagtgcttctaggcccaccttgtctatgtctgccatgtctgattactaactgtggtttatacacaatatatttccttaagttgactctcattttttactgaaatatattttcaaaggaaattttatatcactttcataaatgaaaaaaactagaatatctataaatagtaaacaaccatttaaaaattgatcataatactactgttttaattaatataataaaccattattacatctaattgatttatcaaaaatgaaataacttcttcaggattaaaaaaatatatgtcatcagtcagcaataatgacatgtttggcttaatttaagttaaggaaaggttcttggttaacaggaagtttctatttttagttctaatgatgactagcagtgagaatcacaatttgcatatgtaagttttgaaaaaaataaacatcatttaactagttattgtgatagtgttggacactgaaatcaatcctggcaacatgttgtgagtgactttgactcagcaaatctttgtgtcaagaggccatttgaagcttctgctctttagaatgggctacgttatttaatagaatctatattaaccagtcattactgccatgttgcttggaaactgcaaagatgttatatcaagttacttagccatcttttcataaattttcattaaaatatgactgccaaacaagatcaatcaggtgaccttgatatattaggcttttctcatattgctataaagaaatacctgagactgggcaatttataaagaaaaatggttcaattggctcacaattccacaggctgtacaggaagcataaggctggcatctgcttggcttctggggaagcctcaggaaacttacaatcatggtggaaggtaaaggggtagcaggcagttcacatggccagagcaggaggaggggggtgggagataccagttacttttaaatgaccagaatctcaagagagctcactcaccatcactagaacagcatcaaaggggaaatctgcctccatgatccagtcacctcccaccaggcattggagattataattcgacatgagatttggtggggacatagatccaaaccgtatcactttgttattggtagttgtttgtgggttgaaagcatgaatgatagaaagacatgttctcaggatgcaggctgggataaagtagaagaacacgttctataaaggaacacttattatgtgttaggtactatgctaaatatgttacattaattatcatctcatttaatcctcactacaaccttcctaggtaggcattatttctactcctactttgcagctagggaactgagatcagacaaggtgaagtgatttgattagtctcttaagttaaacttactgccttggtgagcaatggtaaggtattagatgctacaggtctgctgcatacccaaaatcctgaactttggctccaggcctggtctgtgggtcccaagaaaccaaagtgtaggcgagcctagccctgagggatcattcccaggtttctcctcaacccttcttgcccagcctttccctggaaacccaatagcagagagcataatcaagaatgtataaatgtgattataaggagccagagcaagaaatatttcttttttcttccttactgtctacctcacctggtttaatattccctaccacctcattctcacagtctatgcacctatactttagtctgggtacccctaaaaaattatttcttgtaccatgagtgtgcatgcccccctttgggatcactgacgattaaaaccagttccaaatttacaagcctcttgggatatgtttgactcccatataaatgtagctattttatatatttttgtgtatatatgcccattttaatatatgatgaaaatgagttctctaaaaatgttaaaatatgtaatgcatttctgaaatttacaatgagtgcctttcaattcactatggcattgttataaggcggatttttagttgtatcgtagttgataacatattggttttcttttaaatttctagattttttgttttacttaaagaaacatctattggctgggcatggtggctcacgcctgtaatccctgcactttgggaggctgaggtgggtggatcaactgaggtcaggagtttgagaccagcctggccaacatgatgaaactctatctctacttaaaaaaaaaaaaaaaaaaaatcagccgggcagggcatggtggcaggtacctgtaatcatagctactcgggaggctgaggcaggggaatggcttgaacccaggaggcggaggttgcagtgagctgagattgcaccactgcactccagccttggtgacaagagtgaaactccatctcaaaaaaaaaaaaaaaaaaaaaaaaaaaaaagaaacatctatttaatagaaaacacacctaaaaactaaaaaaaaaaaaaaaaagaaaacaactactgatctcactgcctggtattaactacttttaagatttttgtgtatatctttctccatttacattgatttttaatttcagttaagtgagaattccatctcttttttatagctttcactttaggagtaatttactttagttgagaatttcacattcatgtatcttaaagtcctttctctttttggattatattattattttatttttagtatagacaaagtattcttgcttccccaacaagatatggaaattcatatattttgacaaaatatgatgctattttccatgtaaaggacagatatgttttctttgatttctttttctcatagacttgtttatcatttctcttgctctaaattttagaaaggtgttgtttttgccttcctgttaggcttcacctgaacagttatagtgatggtgtggaaggcaattcttactatattagtcatttgatggtagtctgcaacttcaggggctctgtcttaatagttttacattgctataattcagtggctttgaggtctagcttaatacccaaattactaatatatttaggattgttgaaactgcaaatgttcaagctttacctcaaacagtccacaagatattccctaggcttcagggtttgagaatcctctaaatgaacaaagcccattaatccatgctgtatcatagtgactgacacatggtaaactcaataaatttatctattttaagttaatagaattctggcaagattatctgttcattgcatgtataacatggtgaccttaatcttttgggtagaaataaatcagctatcacttatgattttctcaaggaataatggtaccttttcaaaaggataggttttatatactatgagatgtcctgatataatttgaattcatggcaatactgcatttgcctttttttttttttttaccatctttcaagagggctgcctagagataagaatttaagggccatgtgttgtatttttgctagtaccttgaaagaagtttttgctttgtttttaatggcaatacaaataaaatccaaaaatcctggacacatatgataagttcagttgtttatttgaaaagtaaatgcctcacatgccttgctcataccactttaaaatgggattgattgataaacacaaactctaactctcttacattaaagagtatcaacactctgaatttttaattatctttgataatccccatgaacatttttaggactcacacgtaaaatagtcaagtctatttcaagttatgtcagacaatgctttttaatatactgttcagtgcagcaccctaccaaaaactagtcctgtggttgctttatctaattgtgccttggtaagggatttgttaagagtggggaaaaaatacccccagaaatgctttaattaaacagcttcaaatacagccattgttcttacaacagaattgtgtaagtcttctccctgaagagaaatattgctgtagccaatatagctatacaattagtctatgtatattaatgtaaatataatttcattataaaaatgcttactcgtacagaatctaatttttatctgattattttttcaaacactggccagtcccatgagtgaaaatacctataatgtaaggtcagttgccaattataaaaaacattgtttagatggaaacccagggtattcacccaatgtggttattacttgtgcttacataatgaaatttgatcagcttgttttaaaataatctatttaggtcctagtattcacaatatctcttcccagaaataaagacttccttgaagaaagtaaatgatttgaactggaaaaacatgtaagaaatttaaaaaaattaaatatatatttattttaatatatgtatgaagaaagtttttcaagatgttatgatgaaattgattttctttgaggtccaaaatggcctttacatgaggtataggactaagattttagtaaaaagcacgtaccttggtcatcacagaattgttgggaatcattcagagaccatgtagaaatgtttcccagggtgagaaagactgaaccctagactaatattggctctgccaaaaataaaataaaataattttttaaaaattaaagaacttatggagggcacaccctttcattctgtgatttccacgtcaagaggtctcagtggagcatacatctgaaacaaatcatttaagctataaatttagtcactaagatcatctttagatccaacattgatatgttaatttatgaaatcaaaaagtaatatactttatagcttcctcctaaatcttagaaggtactggaacacccatactttgaccattcttttacgttcactaaatttcctaagagtgtcatggaaacagaagaggaatagaaaatctatcaggtaaccctgccctacctggcaaatttttgtgttgtagttgcttttgtttaacatttcttttatcagttaattatacgctgatagagattttagatggactcttggaactccaagaaaaaagaggttctgattcagatgctcttggaaatatagacacatttgagtgtcttaaaagcatacacgagacaaggtctattttccaaaggtgcagagcaagtactgaagcttctccacttgaaaacaacagtataaaaactaccattaaggccatttgttcatttgcccaaagtatccaaggagttgtttaagctttcagccccttatgcatttccatcaaatatgaatatgtgttgctccttctagtagttaagaccagtgacacccatttcttccttgatggtctatattttattgggtatttaattacagagcaatcaactacactgaaaaaaaaataacttgattcagttaagttcttaccccacaatgctcacaggctttactgattatacaccacctcttatgtgcaattgtctttggactaatcagatgtgatgggcttaatgttgtttttaaaccctaacaaatctggtcataggcaaagcaaacctgctaaagatgaagggactagatttaaatgaccttgctgacttccagacccttcttttgatcgtgggcagaatggatatgctcttgttgtggaatataactatgtatggatttataaaagtttgtcaaatgaaagttgaaagttctatattcactttacccaatttactagaaagggaaccaattttctcgttaattacaggctgttagaaaggcgtaatgaaatttcacaactgtccaactggtgcttgatgagaagattactatctatggatgagggttatgtctacagttctttaatctttcctttctttctttttttcctctatagtgtctcctctgtttctcccaaacatctgctctattccttttgatgtcctgttagtcatccccattccatgccactaccactgctctccttttacacttcctttcttctgtcttgtgtcttctacttactcattgcatcccctgaattgttgttgttgttgttattgctgtagtttaaacacatattgacctccatggttaccctgttcaccttttgtgtcaattcatcattttacaattattataatgtatcattttatttatttggaaataatatttatttggaaaaatgtatttatttggaaataaatgtttcatttccaagtttcatattagagcttggatactcaacttgtggtccttggaccagcagctgcaacatcacctagggacttgttagaaatgcaaaacctcagcctctaccctaggccttgagtcagaatctgaaattcaaaaagttactgaggtcactggtgtgcacctgagagtttgagaagcactgtgttggaatacattctcattaacagaagaatttacaaaatagtgttagttatttggtatttaatgaggaaaatggtaaaagatgtttagtcctttttttctcattacattggaagcatatgaggatgcagacatccttcttaactatttaataatgttttaaaaactttaatgtatggccgggtgcagaggctcacgcctgtaatcccagcactttgggaggctgaggctggtggatcatctgaggtcaggagtttgacaccagcctggccaacatggtgaaaccctgtctctactaaaaatgcaaaaaattagctgggcatggtggtgggcgcctgtaatcccagctactcgggaggctgagacaggagaatcgtttgaacccgggaggcagaggttgcagtgacccaagatcacgccattgcaccctagcctgggtgacaagagtgaaactgcgtctcaaacaaaacaaaacaaaacaaaacaatctttaacgtatgatggtattagctgtcatttaaagaagatttttaatcagtaggtcttgcaaacgttacgatttatcacatgtatacagtcaaaagacacaggtaaaaataaacttcaattatttcctttgaagtctgaaggccataaattatattatattgatgtttggttgataaatcaattatgtttgattattaataatactattataggtagtgtttgtggaaaatttactatttgacaaacagtgtacaaaacactttataaaagttaacttatttggtccttacaataacattactaaatttcaaaattacaactttcattttcagaataggaatctgaaggcaagtttcatagcttaaatagtgggcagaactgagatttaaacccaagtctgtctcatgctacaactgcagtttgtaaatcccatgtgttattacctccgttagtcgataatgtacagtttagttcatcagctatgctagtgatagaaaacaatgataccataacagcagcaaattataggcatttgtaaacttttcagaatgaaagttggtagttcttttaataatctcactggaataaataatctcccttcattttagtctttttatgttagacacgttttctccataatttctaagaccttcaaaacattgcaattatatattattaattattaatagcttttatttggtaactttgtaattatatttatatgagtttctctcctcagtattatgtattaggccgggcgtggtggctcatgcctgtaatcctagcacttagggaggccgaggcgggcagatcatgaggtcaggagatcaagaccatcctggccaacatggtgaaaccccgtctctattaaaaatacaaaaattagctgggtgtggtggcatgcgcttgtaatgccagctacttgggaggctgaggcaggagaatcacttgaacccgggaggtggaggttgcagtgagccaagatcgtgccactgccctccagcctggctacagagtgagactccatctccaaaaaataaataaataaaaactttagacaaatttaatattccaggattaattgagcaaataatgatttacaaatcagacagccctcagaaccaacagaggttcagaaatctccacttcacaatgtggacaggcagcctttatggacagaaaacagaagagctgtaaagagaccacttgatgagttacagtctggagcttgcctcccttgaacatggtatgatcagttggctacctgtgattgactgaagttcacctactagctactttgattggctgagactcagctagttgttatgaaagtctactcctgtggtagactttcagttagtttacatactaagttatattgtagtttgttacataaggactcaagtacagaggcatgcttaagtcaaatttagtttaacatgtggtagttagacccttagtttcagagtccaactcttcgggttctgatctgggctttagcatttattagatgggtgaccttagacatattagccttctctacttcaaatatctattagccttctgtacttcaaatatctcattgttaaaatgaggatataaaaaaggcacttatctcacagttttgttgtcaggtttaagttagataacttatgtaaattgcttaacacattgccttacaaaaattaaacactcaataaatagtaactattactattatattttgaaatattgacaatagagattttatcacatgcatccttttatatgtgaatgttggtatacaatgggtagttttgggaatgtgtataactgtaagcatgggcaacctatcagtaacttaaactgataatggcttattttatcatataaaaagaaatccaaactggggtttttgaaggaataaataaaattaacaaacctttagccagactaactaagaaaaagaggggaaacccaaataaataaaataagagatgaaagaggagacattacaaccgataccgcagaaattcaaatgaccattagaggctactatgagcaactatatgccaattacttggaaaatctggaagaaatagacaaattcctagacacatacaacttaccaagattaagtcatgaagaaattcaaaacctgaacagaccaataacaagtaatgagatcgaagctgtaataacaatcttccagcaaagtgcagcttcggactcagtggcttcactgctgaattttaccaaacatttaaagaagaactaatactaatcctagtcaaactcttccccaaaatagaggatgaggaaatacttccaaactcactctacgaggccagtattaccctgacaccgaaaccagacaaagacacatcaaaaaaagaaaactataggccaatatcccagataaacattggtgcaaaaatcctcatcaaaatatgagcagacataattcagcaacacattaaaaagatcattcatcagctgggcgcggtggctcatgcctgtaatcccagcactttgggaggccgagacgggaggatcacttgaggtcaggagttccagaccagcctggccaacacggtgaaactccgtctctgctaaaaatacgaaaaatgagctgggtatggtggcggacacctgtaatcccagctactcaggaggctgaggcaggagaattgcttgaacccgggaggcggaggttgcagtgagctgagatcgtgccattgcactccagcctgggcaacaagaacgaaactctctcgaaaaaataaataattaaaaaatatcatttatcatgaccaagtggaatttatcccagggatgtgaggatggttcaacataggcaaatcaatcagtgtggtaaatcatatcaaccgaatgaaggaaaaaaacataggatcatttcaattgatgcttaaaaagcatttgataaaattcaacatcccttcatgattaaaaaaaaacacccttaaaaaaaactgggtatagatggaacgtacttcaacacaatgaaagccatggatgacaaacccacagctagtatcatagtgaatagaaaaaattgaaagcctttcctctaagatctggaacatgacaaagatgcccactttcaccactgctattcagtgtagtactggaagtcctagctagaggagtcagacaagagaaagaaataaaaagtatccaatttggaaagagagaagttaaactggccaggcacggtggctcacgcctataatcccaccactttgggaggctgaggcgggcggatcacctgaggtcaggagtttgagaccagcctgaccaacatggagaaaccctgtctctactaaaaatacagaattagctgggcatggtggctcatgcctgtgatcccagctactcaggaggcggaggcaggagaatcgcttgaacccaggaggcagaggttgcagtgagccaagatcatgcctttgcactccagcctgggcaacaaaagcaaaactccatctcaaaaaaaaaaaaaaagtaaaattatccttgtttgtagatgatatgatcttatatttggaaaacactaacgactccacaaaaaatattagaactgataaacaaattcagtaaagttgcaggttacaaaatcaacatacaaaaatcggtagcatttctatatgccaacaatgaataatctgaaaaaagaaatcaagaaagtaatcccatttacaatagctacaaataaaataaaatacctaggaattaaccaaagaagaaaaaggtctctacaataaaaactataaaacgttgaataaagacattgatgaagacacaaaaaatggaaagatattccatgttcatggattggaagaatcaatattgttaaaatatccacactatccaaagcaatctacagattcaatgcaattcctatcaaaataccaacaacattcttcacagaaatagaaaaagcaatccaagaatttatatggaaccaaaaaatacccagaatagccaaagctatcctgagtgaaaagaataaacctggaagaagcacattaccgagcccacgttatgctacaggccactgtaatcaaaacagcatggtactggcctagaaatagaaacatagaccaatgaaagagcatagagaacccagaaacaaatctatacatctacagtgaacttatcttccacaaaggtgccaagaacatacattgagtaaaaaaccatctcttcaataagtggtggtgggcaaactggatatccatatgcagaagaatgaatctagacctctatctcgaccatttacaaaagcaaaatcaaaatggattaaagacttaagtctaagacctgaaactatgaaactaccagaagaaaacactggggaaactctctaggacattggactgggcaaagatttttagagtaataccccacaagcacaggcaaccaaagcaaaaatagacaagtgggatcacatcaagttaaaaagcttctgcacaacaaaggatacattcagaaaagagaagacacagccccaagaatgaaagaaaatattagccaactatccatgtgacaaggcgttaataaccacaatatacaaggagctccaacaattctatgggaaaaaattaataatcaaattttaaaatgggcaaaagatctgaacagacacttctcaaaagaagacaagtaaatggtaaataggtctatgaaaaggtactcaacatcactgatcatcagagaaatgcaaatcaaaactacaatgagatatcatcccaccccagttaaaatgggttttatccaaaagacaggcaataacaaatgctggttaggatgtggggaaaagggaacccttgtacactgttggtgggaatgtaaattagtacaaccactatggagaatagttttgtggttcctcgaaaaactaaaaatagaactaccatatgatcttgccagccccctgcaaggtatatacccaaaagaaaggaaatcagtgtattgaagtgatatctgcactctcgtgtttgattactgcactactcacaatggcaaagatttggaagcaacctgtgttcatcaacagatgactgaataaagaaaatgtggtacatatacacaatggagtactattcagccataaaaagaatgagaccctatcttttgcaacaacatagatgtaactggaggtaattatgttaagtgaaatgagccaggcacagaaatagaaacattgcatgttctcacttatttgtgggagctaaaaattaaaacaattgaactcagggagatagagagtagaatgatggttaccagatatgagaaagggtaaattgggagggggagtgggagtggttaatgggtacaaaatttagttaaatcaaatgaataagatctagtatttgatagcacaacaggctgactacactaagcaataatttattgtacatttaaaaataactaaaagaatataattggattgcttctaacacaaaggataaatgcttgaggtgatagatatctcatttactatgatgtgattgtcaggtattacatgcctgtatcaatacatctcatgtaccccataaaaatatacacctactatgtacccacaaaaaaaaatttaagaaaaaatctaaaggcaggcatatgagaactgatgtgccactaagcattaaggtttctttcatttttctgccccgctatcttttaatttgtaagtttcatcctcatgttcacagaatggctgcagtaagctggatattacattcatatttcaggaagatatgggggagaagagcaaaaggggaaatacaaaaacctgggaatgatggggaatgctatctgagtctgtccatgctaaaaaatccttcctggttttcctatgaaaagatttctgcttccatcatcttggcaaaaacctggctaggtagctacccctggctgcgggaaagtctaggatggtaagtattttagttttctattctctatataaaggaagacattggaattgaatggctttggggtaattgattcataatatctactatagtactcattaatcagtcagcagccagtcaatgaaccaaagaaaaaagtcaatatgaaaccctttaaatgaagcatatcaaacctttttaaacaaaatgaaattcatgtatatttaaatatgatgatccctcttacccagtattttgccactaaagtgttagaagtaaggaatgaaactttacacagataatttattttggcagcattgctatggtgctaggaaaaaaattgtccctagaacagaccctgaaaacaactgctcatagcaaatactcataggtgtttctgctgctacagataatcacagaagttgccagaaattaaaatgtgcaaaggataaatacaaatctttctcctttgcaatgttggagagatcttgcttcttttttaacctccataattttgttgccctgttttgcagcatctttgcaatgtttctgggacagctcagtcatcaccatctcaatctcattcaccacagaacaagtgcttgtcaattgtaaatgtgtaatctcaggaaattcttgcctgctctcttcatctctggccatttgtcctccaacccatccattcatagtgctgttataagcttcccaccccagggttagtaatcttccagggctctgtttcatccagaaagccatcaatgggctgtacctgctgcagggggatctttcactttccacacccttacagcctcacatttatgaaagtcttctccaaaaaatcttccttattctattttgaaggaaataccttctacctagaatatgtttcattaatcctcaaggcaagatataattcttccatcaacttgacttgaactaaactgacaccatgctaattttttctttccattctttcctcattgtcaatatgtttttactgattccttgcttcattcattgattcatctggcaaatactttttgagcatagaatatgtgcgagaacttttgtgaaagataggatttatagagatcaagaaaatttagggcatgttctcaagggggtcacaagcttttgaggaggaatgattctacgtttatattgggatagcctctggtgttttggaagtcttgagctgtaaccgaccaacctttcattctccctttccatcacccctttgccaaacacacataccttgctatgaaaaattcttaagggcaacagggattcattctttccttttcttttggctttacatcccgttctacaaggactcagtgggattctaaaaaaaaaattattttttctaaaatattctggaaaaatatttggaataaaattgagatggagtgagataaggatattttcttgacttgtgagaaaaataacacaaccaaacatcatacaatgtgattcaatgaagattcatgaaaaaaatacaatttcaaacttcagaaattaaaaataatagacctaataatatttccctttgtatgtatgtggcatgatgttgttatattacttggtagcagagtggaaatttgagcataatctaggttgagagaaaaggtcattattcttagttctgtgtttttccaatatactgtgttcttcaaaatataccaaaaattataaatcagtaataattgatactttgtacagatttttttattttatattttcttgtttctcttgcaatatcttttctttgattttttgtttgtttgtttgaaacacgtatttgccactgttcaactcttacacctacattctcttttgcttactgaggggaaatgggccccataaaataggtgtaactcagtatctcagttcatgttcaaacatgtataaagatgacctctttttctattcttgagcaaaaactaaatgctcatgatatattcttttatgtaaaatctagttattcaagttaagttctaaatgaatttttcttcatcttatttaagagtaagtactttttttcttccatagtactaggtaatcgttttcagtgatctgaaatacttacgaagaagttaggatctttgcaactgtttgaatctcaaattattatttgttctctgttggctgtaagagctcactcattggaattacaaaaccctttctctttatagctgaaagcgtttaatgtatgcaaacttacatttggcttgagaacatttttaaaaataaacttttcaaattggaatgttcttactgaattcaggcttttatgatgctgtttgatttggcatatgttcctcctgatatctgcattgaaaacactttgcatttgagagacttttcctgccttattgggacatttcaactcaatttatagttatcagtaggaaaagaaagaaaacatttccatccaaaagaggtttcagtaggatttagcagtaagtgctttaaaaagaacaacagcagcaagcttgaacctttgcccattaaaaaaaatatatcaaaaacaaagaaacattacaagattctctttccctttttaaaggatccacagaaggaaggttcttcctagtctatttgaaaatatatcagacttactcaagagactttttttgtctattttacctgatccacttacattcagaatcagtctgaatttattacacaatgttacgtttactgctaaaatgctggtcgttggttcaatacttggatccttcagagagagcacatatccatcaggatgcatttggctttacgtaatagtcaatttttggaagtttagaccatgaagatgactactctttacttaacagaagtctggggtaggtgttgctgtggttggaaaggtgcatgtatgataggtggacagctccctgtttctttataaatggcacatacctggagaactagcacataggtagctcaataaacagaatgttaccaggacccccagaaactccctttttattctgttttggttctcactctccaaaggcaatcagcgttcagagttctgacaatgtaagttatttttcctatttttgtaccttttataaatgcaattatgcatgatatactcctttgtgtcaggcttcttttcttcaacattatgcttgtgagatttactcacactgtggcttgtagttgtagatagttcattctcattactgtatagtgttacagtgtcagaaatatgcaccaatttatatgtctattctactgcttgaggagtttccagtttatggctattacaaataatgttacaatgagcattttgtttttgtttgtttgtttgtttttttgagacggagtttcactcttcttgcccgggctggaatgcaatggcatgatctcggctcactgcaacctccgcctcccaggttcaagcgattctcctgccttagcctcctgagtagctgggattacaggcatgcgccaccatgcccggctaattttgtatttttagtagagatggggtttctccatgttggtcaggctggtctcgaactccagacctcaggtgatctgcctgcctcagcctcccaaagtgctgggattacaggagtgagccaccacgcccagcctatacaatgagcatttttgtatatgagcatttagtatacgtctttgagtaaatacaaacatacaattcggcttgatatatatctaagaaaggaattactgagtcatagggcatacatatgttgagcttcaatgacgctgaagagaaaataacacaagcaaacattatgcaatgtgattcaatgaagattcatgaaaaaaatgcatttcaaacttcagaaattaaaaataatagaccagttttccagagtaagacatctttttttttcattcttagatcatattttgcgttttgtaaatgcgtttcccaatcagcagggaaaaaaatataatatgcaaactaaagcatgtatacaatgaattgcatttagtttaaaacaaaagatttgaaaaacgtaggaggagagagttatatttgtattagttcacaaaagaacatattcaaaaaaaagcaaataattgtattttgagtgtatcatagagttaaaaaggatggagtcaggctttttgaaaattgacttgttttccttctccccttttaaagaagataggttattgaggaaaaataaatttttgtcatttcagagagtacctgttcttttttttttttttttgtagaaaataaaacccacctataaaacatgaagattaagcttggggtagctcaagggaaatgactcaaaccatccaaacacttgttttttcttttttcagtttttctaatgtaaagttaaatcattaaataaaattttggtagctatatttaagtctcccttattttattttttagtaatattaaattattttaggacgcctgattttgtggtaagaaacatcaaaggtcttgatataatttttgaccgatgggctttgaatcaaccaattctagcctgtgggtagaggacagagcactgctgtctcttgcatattaacctttatggggctgctggagttgtggacattgagtatatagtgctagtttgtactcggattgatttattttcaaattttcaaaagaatatctaagttcaatgatattcttttagtttatctctcactgtcaaaaagtctcctccaatgtcattttaagtgagaaagttaaatgatattttgaaacactggcttggggaaaactgcagttcagtttgcttcaatgagaaggaaaaataatttccaatattagattacagtgaaaagaaatataaaagagagttttactggaaggtctgccttttatccttttaacgtttcatggaactagaataagaatatcccattttgtctaagatgtacctttaagcaactttttaagcctcaaggcacttatcttatacattgtgctcttcagctgtattaccagaagtcttttgtttaaaaaagcctttggtaaaattcttcaaatatgaatttaagcctgaacaacaacaacaaaaaggtacttaacattgctgcctttctttatgtaatgatcaagtcctcccatgttctcctttatatcagtaagccattttcttgaatccctttctaaaatgaggttaaagaaaaatgtgacataaatcctatatgtatgttctgatttttaaagggtctttatctttacttttactggttcgaatatagaaattatctcctcccgtttccttctcctcaattagctgccaatggtctggaatttaacgattttacctcatgtgattctatttgtttgtaatcctatattcaacattgtactgaagtctgttaaacattgataagccggtttttatgcagcaggtcctcagagagcattgcactaaaatgctgcaaagactgggattaggtttacgtattgtaaggtggtttcgagacgttttcctagtgtctgttctttcaaaggtgccaaatcaagttggccttgatttaatattgcgaaaattgtaatgctgagctgacttggagcttcacgtacttcaaaacgagtttttccgggggtgatttaacaaacagttctaattttttgagtgctgccgaatgtaacgcacatatgggacattattgtgtagtttctgtgagacgctgaactctttgccaaaaacttaagtttctttcattgctattcaagttataccttcttctgttatctcttgccaggattccaacagcctcagctgatactggtttcatttagtaaggagagtggcattggattgtatttcttctgatttttacaaaataaaaatcctcctgcatcccatagataaccactattagcatttgggattatatctttttcatatgtttcctataggtagatataaattttgaaaaaaaaggtattttgtttgaaagattcttttgtaactcactttaaaaattttttattatgtaatcatatatataaaagaatatatatgcatatatgatacaaagaataataaaatgaacacctgtgtaaacaccacctaccttacagaatagtaccaatgttttgaacccccatgtgtctctaccaaatgttcatcttttccctatcttgcaaagataactgcgcttctgaattttgtatttgtcattctcttcctttaaaaaaactgtttcactaaatacatacgtgttcctaaataatatattgttagtttgggtgtgtttttgaactcgatataaatgtgataatgcatataatcttttctgactcgtttataattccacattttctccgaggtgcctccacactgatgagtacactggtagttccattgttttgactgctatttagtattgtatgatataaacatatggtgctttttacttaagttcttgttgatggtgggtggcttgatctcaacttttgcactgacaagcaatcgtcttatgaaaattcctgtatacgtctcctggtgcacatgagcaagaatttcttcagggccagtgactagggatgagactgttgggttattagataaatgcagtcaaacttcaaggcgatgccatattattttccaaaatgattcacaaataacgctaagatgtcattgtgtcaaagtttctacactttcctcgatccttaatattgttctaaagccttcataaaatactatctcattgaatttacatttccctgatagtgatgttgcacatcattttataagaggtaactatctgtccctcctgttctgtattataattttcatcagcttttatattgttaaatattttctccctgtttgtaggttgtattttcacttttcttttttttttttttttttttttgagacggcgtctcactctgtcacccaggctggagtacagtggcgccatcttggcttactgcaacctccatctctcaggttcaagcgattctctcacctctgccccccgagtagctgggactacaggcaggcaccaccacgcccggctaatttttgtatttttagtagagatggggtttcaccatgttggccaggctggtctagaactcctcaaagtgatccgcctgcctcggcctcccaaagtgatgggattataggtgtgagccatggcacctggccatattttcactttattaatagtataatttgaagattagaagttcttaattttaaatattatcaaatttattgttaatatttgccttaacggttagtgatttgagtctcatttaaaggattatttcctaccctaagatcatacaaatattctccaatattttcttctgtaatgttaatacattttctgtttatctttataatctaccaggaattgagtctttgaatggtgtgagtgatttgatttcttttttttttttttcaataggaacagtcaggttttccatcactgcatattgaagagtctattcttcccctactgaactgcagtaactaccctggtcctgtatcacatgtattagaatagaaccagctgctataataaatattcgccaaatgtcagtgacccaatacagtgtgactggttttagtcaatgctttcctccacttgcttatttaatgacccaaggtccttctctttcatgtctgaccattcactaggacattatagtctactgcagccagctggcagatggaagaagaaagggtagagaaggcatgtcaactttggtttttttttttttttttttttcctgaggtggagtcttgctctgttccccaggctggagggcagtggcgagatctcagctcactgcaacctccgccccccaggttcaagcagttctctgggcctcagtctcctgagtagctacgattacaagcgtgtgccaccacgctgccaccatgcccagctagttttttgtatttttagtagagacggggtttcaccatgttggccaggctggtctcgaactcctgacctcgtgaacctcccacctcggcctcccaaagtgctgggattacaggcgtgagccaccgtgcccagtcagcatgtcaacttcttaaacaccttgtttagcaagtgattatatcacaaccgttcataatccattggtgaaaactagtcatttagccctatgtaaatgaaaagattgctgggaaatgttccctgatggaaagcagcttctcagaagcatctctatctacagtgtgggataatatgaatttggggtgtttagctagctgtctcaattatatcaagttttcgtatatgcactggtctttgtctggtagggctagtccctcctctttattgatcttcttcaagtgtgtctcagctattctttgtcccttttcaagtatcacaaagaaaaaagtcactgtttgaattgggaagctctgaatctacagggcagtctggaaataatatatttacataatgaggctacttacccattagcagtgtacctctctgtttacttacatggtctgaaatgtctttcagtatactttacagtcttattcaaaaggtcttatatcacttttgttggatttattcctagagattctgcttttttgctactattataacctgccttttctaaacttccctttcatgtctgccaatacatagacatgaaattgatttttgtatgtaaattttgtatcttgacatcttggtttggtttgttattaattccagtaatttgtgttcagaacttttggagggggcttgtatgcagatgatcatattatatatgaataatgataagtttttatttctcttctaatttttatcttttatttgcttgtctaactgaaaagcagtgataggcatctttgatttgttccttattttagagggaattattttgacatttcatcatcatatatagtttgctctagtttttttgtaatgcattatatcttctttaatacattgcgtgattctgtttgccaatatcttctttagaattttccatttatgttcacaagtataatattagtttatgattttctgttcttatactgttctgtgcttagttttggtatcaagattattctagcttcattttggagttgaaattttcccattttctgtttcctaagaatttcttatgagtttggaatcatctgtttttcaaaagtatagtagaactcacccataaaaccatttgaggctgctgttttctttaagaggacattttaacgctaattttgattttctaatagttaaagagcttttcagttttctcagctcttcttagatcagtgttgataaattctgtgtttcaaaaaatgtgtttgatttattttagctttcaagtttatgggcatacttccttcatggcttttaaatctcttgtgagaatatatgcacacctcttccctttattgatgtcttctttccttttgtcctgatcaatttttcaagtaatttaaaattttgtctcttcaaatattgtctctttaaatattggatattttgaagttctatattgatttctgcccatttatttttttttctgctgctttattagtatttgtttggtttttcttttgttggtttgtttgtttttttgagacggagtttcactcttgttggccaggctggagtgcagtggtgtgatctctgggctcactgcaacctctgccttctgatttcaagcaattctcctgcctcagccgcccgagtagctgggattacaggcatctgccaccacacctggctaatttttgtatttttagtagagatggggtttcaccatgttggtcaggctggtctcaaactcctgaccttgtgattcgcccgcctctacctcccaaagtgctgggattagaagcatgagccactgagtccagcctatttgtttttccaattaagtgtttattatgtgtatttatgttaactttctactataaatattacgaatttttaaaattattccttaaaggacctcaaatattttgctcatttacttctactatgtttacatttccattatgatttcttcttttacccatgaattatttggaactgtatttttaaattttcaaatgtattttcaggttatctgtgttatttctgtctaatttgattatattgtatggtatcaattttttaaaattctgagaatgttttattgcacagtgcatgacagctttctgcaactgtttcatatgtgcttaagaagaatgtgttgagtacacatttggaaacgtgatttttgcaggttcattaaatcaggcttgttgattgggttaatgggatcttccacatgcatgtgttgaaatgacccactaagctcccagatttgattagttaccttgtagttctgtctgtctagtttcccctatatatgcggaggctgttttctgaactcatttaaagtttggaataattttattcaccaggaggattgacctttttattgttatgtagtcttttgtctgatatattattatataatttatatgttagctttcttttagtttgtattttcctggcatatctttagctcgtatcctcaagttttctgttctcggtgtttatatgtctctctctcccttataaaaagtctattgctggatttaaaaaatctgtaactccacagatatcctgtctgaccacttttgcctttcatatagggcttttagttcactcatattttcatgtatatttattacaattacttttatacttgaacttatttatagcattatattttctgatgttgactttctttgtctttgctcctctttttccttctttactgccttctttttgagtggttgagttttatattcttactctaattttccttcttccattttggaatttgtgcactctttctattattttaggtgttactcttaaaattttactatgggttatttagcaaattaaagaataatcaatggtttagtttttctttccagataaattaagaacctttatgaataataacttctctctcattgtacccgttctcattatccagtgtttagttctattttgtatactttaatcttcaatattacatattatagctatagttttatataattaattttatttaaatgtattcacatgtttaccacactctttgtataccatttccaaaatgcttgggtaagaattgatactttgtccaatagcaagggggggattatggacatttttcatctgaggaaagacatgatcaaaatgatactttaggaagattaatctgatgcagtcaaaaaagaatggagggaggaggagatgataagtagaaacacaaattaaaggctatgacccgggaacttggtacaatgatttgaactagaggggtggtaaaggagaaaaggagtaagaacaggaagtaaaagtcactgtgaaagaggaatacacagaaattaacaagtggtttgcttgaagtattgaagaaaacaaaaataagaatgagatttttgaaccaaggttactgaaatattggtgaaatattagcaagtaggaagtcagagaaaagagctgctttcaggagaaagataaagaaatgcccatggcatataccaatgatacactcagcacagaggtctacatacaacagagtacttgtaaatacaatagggtacttgagagaagttaagactggggaaataggtgttatagtggtaagcatatatgggtcattagtggagaaaaatatcgaagagagtgaatgatgtcaaataaaagtgctttgtgtaatgttggacagagatatacccccaaagaaaatgttcaaattttgaaagcccaacaagagtcagcactggagatacagaagtcaagtcagggagaatctgcttttgtggaatatcatctatatgtggtactgagatagatatttcatatatattacctgatataactatcaaatgaggaggtggtatggtaccagtggaggagaatcattcaaaaagaacaaggtgttcagcagtgtcaaacgatgcagaagcactaagatgagaatgagaattaaagaagatgtaattgtgtgattaggatgtgattgaaacgtttgcagataatgagttcccagggaaagagacagaaacaaaactgtaaggacttgatatggaaatgaatcctgtgccagtgaacactgaaatgcaaacaagacttaataattcagtgacaagggattgtagcaaggctcagagaagatgcttctgatttaaaatagaatagctaagttatgtgacgaccatactgtctatacataatagacactaaatttatttgttgaatgaaaagctaagtgttcagagtttgaaaaataggaaccagagggaaggacaaataagcaattgaaagttactgaattgataagttctgtgatttaaaaattccagcaatatctgtaagaaacacaacttcgtggaattctacagataaagcacaagctttggactttttgtgatttcttttctgtacgtgtttttaaatgtacagcaagtgtaggaagataagcgttgataaaacattacttgagaaatgttaatttgctattaataacaattgacatttaccattttaaaggccaaagagaggtgaattttgataaaagataggttcttacttggaaacgtgtatgcaagtacactgaagaggtcttcttaatatagcattttataactcatctcaaatgttagcagccctgtttttcattcgtttccaaaactcatcaaccccagtcataataccagccacttaatacagatcccataagtctgtcatgtgttgtttacttaaatgtgactgtttctgatgacttttaaagtccccaaagcagttttgtccacgttaattttgctctgtatctcagcattcattgcagtacctattgaaagtgatttcactagcataagataaaaatttgatgacacatttaataggcttactctcaaacaacggattgactcaaatattatcaacaatgcaaggtgggctcttatgccaagatgtgttcggtttttcaaattttaatctaacgcctgaaatttgtgttgcataaatgtttgtcttattctgtgtataacatatttgcatatgtatatttgtgttctgtataagtacagaatagttaaaatgtgttctctctatgcttacataaatgtagcagtgagatattgataatagcaataatagctacatttattgattgttaagtgcgaagctctgataaaaatgttttataggtatcattgtacaaatcattcaaataaacttctgtggaacatacaatggttattcctattttacagaatggggtgaataaagggacacagagaagttaaaataatttactcgtggttacagagccaggaagttctagagctagatttctaacccatgcatgctcactctattgtgtacccagtaatcaactggatatactgtgattttatattaatcaaaatgcaaagatgcagaagttgtgagaaaattccctatctctagccatttattttcctgaataaaaatacatctataaatttccccttatctgatgacatcttaaggaaatggtcatgtaagccaagaatatatattatagtttactactaagttgttagaacaagctaggcaccagtttatatagtctagaacaatatactcaagtactgatgcttattatgcccaggtggtagtggcattatttgagaggttatgttttgtgtgaaatttctactttaaaaaaaatgaatttgttttgacaaaaaatataaaatgggcaagagattttgaaacaagtttacctagatttgcaacaatatatgttagaaactgtttgctttgattatacacacatatatgatatcctaacatgtatgaagcaattctttagttgatagtgacttatcttaaaaatgtataatccaagaatcatggagcattgtatttagaatttaagagtatacattttaacaaaacacataagaatataatttttatacaaaacgaccaaaactgagtctttaggatcatagtttaaaaaatgcaatatatgttctcataaatatatgtaaatatgtatcatatatagtaaatatatagttacataaaatacatatatttacatagatgtaaggatgtataaaatgtacccttaaacatgtttaaataataaaagaacacataaacattatacctacatttattttattctatattctataattctccaaaagtgggaaccattttcttacaattacttatggacccaaattcctcaaaattaaaagatcatttcattggcacacttacaagagacttagctgacaggggtagtttttaaaatcaaattaagtggactccagtttcagattcatcagttaaggagcttagaaattaccactcaattcttaacaagtaaaaagctgaacaaattgaaaatcaacaacttttctcagatctgtcagacaactgaggtcacagggcaaaaagctgcccccaaaattgcagaaacagattgatggatacaaagaatcacaattttctgagcagaaacctccaagggaactagttccagggtacaaaaacctgtaattgacgaatctttggaggctaagtgtggaccaagtctgagagttaaaaactacaggacagcccagtcataaatcatagtagggggctgatgcttttgtgagttttaccttcaggagccttaccaagtcctaatagtgagcatcagagaaaaatccctggtgcatccatcaaggaaagggggaaaatacagattttgaattatacacaagataattctgttgttagcaaagtctgcccttaggagaaactatttttccagaccctagccttatggggtttaatcagagcctaacctacctggaaggaattgaaataattcaacttcagctccttctagtattctacaggggcatagggaaataacaaattccaccccgctctggccatcctgcccacccaaagagggaaagaaaacaactcagactcacttgtgaagctaacagtctaatcacacagacttacccaagatagtttcttttgctgtgcagaagctctttagtttagttcggtcctacttgtcaatttttgtttttggtgtacttgcttttcaggactttgtcataaattcttgcccaaggcagatgtctgcaatggtgtttcttaggttttctgctagaattattatagcttagagacttacatttaagtctttaattcatctcgagttattttttatatatggtgaaagacaggggttcagtttcattcttctgcatatgactagccagttatcccagcaccattgattaaataaggagtcctttccccattgcttatttttgctgatttggtctaagatcagatggctgtagatgtgtgactttatttctgggttctgtattctgttccattggtttatatgttgggttttgtactggtaccatgctgttttggttactgtagccttgtagtatagtttgaagttaggtaatgtgattcctctgattttgttcttttcacttcagatgactttggctattgaggctattttttgggttccgtatgaattttagagtagtttttttttctaaaattgtttcaaatctctacaatgtcttccagaagctagaaccagaggaactagttcttaactcattctatgaggccaacattaccttaattacaaaattagtcaaagacattacttgacaagaaaaatgcaatccaatttctctcaagaacatagacgcaaaaatcctcaactaaatattacaaatgaatccaataatgtataaatagcatcatgcatcatggccaagtgggatttatcccagttatgcaaaactggctcaacactcaaaacttaattaatgtaatctaaaatatcaatggactgaagaagaataatcactttatcttatcaatagaggcagaaaaagcatgtgacacatcccaaaaccctttcatgataagaagtctcagcaagtagggataaaagaaaacttcctcaactcgataaagaacatctacaaaatacctacagctaaggtcatagttaatggtgagaaacaccaagctttcctgctaagatcaggaacaagacaaggatgactccactcaccactgcttttcaacatcatactggaagtcttagctaatgcaataaaacaacaaaaaaagaaaataaaaggtacagatgctccttgatttatgacaaggttacatctgcaaaaacccctgatcagtagaaaatattgttaagtcaaaagtgcatttttcaacttaccatatttttcacttattgatgtgcttatccagatgtaacactatcttaagttgaggagtgtactgaatgtgtatcccttttgcaacatgataaggctgaaaaattgcaagtcaaaccactgtaagttgtagactatctatatagacagggaaagaagaaatagaattgtctttgttttcagatagtatcattgactatgcagaaaaccctaaagaattgacaaaacagcagcagcaacaataacaaaaaaacacctggaacatttccctctgatcctagacagaaaaggttctccacctttaggtccttaaggactcatgtgattcagttgagaccactcagataatccacaataatctcctcatctcaaattcttaaccttaatcacgtctgcaaagtcccttttaccatgtaaatttgcatgttcacaggttgccaggattagaacatgaacattttcgcaaagggctttgttttgccttctatatccagtcaattacttccagttaaaaaacttatttatgttatataacacttgatatttgccaggtgttatgctaggtgatatttaatattttaaaatatctgtgaaattagtgatatcagccttagaaacatagatggaggggttggtcaccactcattatttaatgtaagtaacttatctttgtgtttttatgtaattattctctgaaatactcttattcaacaagcaagagtattcatccagcattaggaaaatattttatctttaaatttaactagaactataacgttttagaagtaggccatcactatttaaactcttaaaaagtcatagttaattaacaccctcatatgggtctttgattatcgctataataaaatctccatttatagataagagcaatgtgcatcacatgtaatgtaaacctgtattaatagattagatgaaatattattttctaactgtaagagttaattactctgaacaattccacaataaatagtcatagaaattgatttgggatatatacatctctctctctctttctctctctctctcacacacacacacacacacacacacacacacacacacactcgccccccccacccccaccccacccacacacacttctttctttgcttcttgcctggctgtaaatcggctatttttccatatcccatcatgagcctaaagggaaacatttgtatatttcaggctcctaggaaagcattttgaaaattcatttaacaaaattgggcaatatcaatgacttcaaaattagcaatggcagaaaagaagtagtaattaatagcagcggaaggattaaaatgtgttaagattaagttaaacatgtcgttgaatcactgtaagagactgctgattgcagagcctcttagtgtttgatattactctgacttgatgctgtggaattatatttctgaaataaatagttcttagttctgaggttatgctaaaggacatgttcaggaagagctttcctttcttactgcctagtcatacccttaggcaaagaagcagtaattttgaagggacaatgtaaaatagaagaataggcaatcttggatatgtgtagtttcacatttcatgtttatagatgtaaaagtattatgttaattatagaatagcacgttttatttatttatttatttatttatttatttatttattttttgagatggagtctcattctgttgctcaggctggagtgcagtggcgcaacctcagctcactgcaatctctgcctcctggtttcaagcaattctcctgcctcagcctcccaagtagctggaactacaagtgcctgcccccacacccagctaatttttgtacttttagtagagtcggggtttcaccatggtggccaggctggtctcgaactcctgacctcaagtgatccacccgcctcagcctcccaaagtgttgggattacacccggcccaatagcacattttaaagtgaatttatgttcaggtaacatgaatagaaagatttcttgaagtttcaaccagcttctgaaactttgtaaacagattaaataaaatttgatgattaaaatatattcagttaatacatatgaaaagattcaactgtaaaatatgactaaggcttcccgctaataaatggcattatgacgaaatctgtagtaaactgtgggcaatgtatatggatatgattttaaaatcatgagaaagctcattactgttggctatgtcattatagcatgatttttttccttataatatgccaatcaagagtaactatgttatgttaaaaggagaaaatgtggtgttttaaaagtgataaacctgatgtatttaaaaattttttgagatttcctctggagctgcactgcccaatatggtagccactggccccatgtggctgttgagcacttgaagtgtggctagtagactgagacatgttgttagtgtgaacacacactacgtttcaaagacttcatatcaaacagtaaaatactttattattaattttaatattgattacatgttgaaatggtaatattttagatagattgtgttaaatatgcatattattaaaattaaatttagggtttttttcacctagtttaatgtggctactagagcatcttaaaattatacatggggttcacatttgtggtctgcatcttatttgtgatggacactgttgttctaaactttcctaattactgagacatttcccttcatcactttttgggatgcagttttcatttataagttaatggtaaaactgcacaagtaacggaaatatacttaaaagatcaaaatatgaaatttagcactttcaaaattcctcatttaatgcttgagtcaatccttggaaaataattgatccagaggatatttacaaatagtccatcatcaaaaataaagaggggcatagaaggtactagagctctatgtataaaatcctgccctctggcctattctattatactcagaagagtctgtgtcactaatatatagtaattatcgtcggaaattatttgctatattaggattccctatggaaaagtgaattgattgaaaagatttagcaaagagttaactatcaactttggtttttaaataacatgtgaaagctaacttactctaatcactctgtggccataaaaaaggctctgcctccaacctccagaatctacatccaacaagaagtcttggtgaaaaggattggcaaaaagactgcaggttctggcaagggtttgtaagtggaccaacgaattggcatttgaaattgttagtcttataaaatgaatcattgagactggaaggtcaatgtaattggcaagccatgtgtcacctttttcttgggagaaaaacacatcatttccataaaaaagtatagagcatataaaagaataagaaagtaatgataaaacagaacttacagtgacattaaacagaaaggtatttatggtaatggatttggtactgaataataattaggctaataggataaattgctcacaaatggtacatttgggcaggaatagtgtattgttcactaatgtatctacaaaactgaatctaatgcccagcattttgtggaagggaaaaatgaattaacgactaatgtcatatatacataaactagctatcaacaagacaagctagggattagagaagacagggaaagaggaagtaatgctgatgcctctaaacatgaccaagatttattcttcactccttttagtgttttcaacgttaattcctgtagtgttctcttgccttctcaaaccagacttatttttaaagcagcttaggctgagtagcatatttttataaaatggtcctctgcgccatttctaagaatcataggtcaaattagtcaggctgctgttctaacactgataattatatccacctcctaccaaaatctgtagttaattggtagaaattcaagctttgtagattttagttgttaaaagcgtcacatggagaaagtacaaaggctgtcctaagtaaatgactttaagattgatttttgaagccttttctttactcaaaaaaagtaatggccagcttaacaaatgcctccagatgaattgcttgttgtgttcatcattattatattacacattcccctggaaactgcagatgataagggtgcattttattctgaatgttgtgtaaggcacactgcattttgaaagagttcagtgatgttaggataaatgtgtatgagaaatacgtttgaatagattcagtaagtctattcactagtccctttttcaccatttgctgtttggaatcaagtttgggatgttccatgcatggtcatcttactttagggtatagaacatcaggagtttaagaaactggggtttttgttttgactgccatcattttgctgtgtattacttgacaaggaatagaaggggaggcagggattagatcaagcaaagaagtacccagtaagaaagacctttcaacaatgtataaagaatttattttaaataaatttctgaaatggttaaaaaaaaaaggcagagatgagttaggtgaggtgagtcaagcaaggtggctgagggtttagattttggaaagtcacaacataaccttttacaactgaaatacatcatctgtaccatgcggataattgcatttatgtcttggtggtgttggaagaattaaagggtataatatatttaattcacttaatagagtgcctgacatatattaaattttcaaattgttgttagagtggctgcttcaaagaatagctaattttacagtatggtatcatggacacagactgtcaaaagccaacagaataatttcaaattcaactttttttccacatatggctttgtgagttgagtgcatactttagtcaaaaatatgttttcacagagtgataatttctaggggtgattaaaagtttgattataaccactcttgggtttcataatctaaaaacattttcagaaagtctgtgattaatttttcccatttaaaattttattctcaataatgtgcagtattaaatagaatttcacaaggcatcttgggagttacgctctcacatattaaactacacagaaaaagttatatgtcatagctggtcaagaactcagagcaaaatgaaaagataagcagatagtgcaatgtggttcatggtccttaaaagaccttttaatgtggttggttattttctaatgaatgcaagtaacacattgaatgcccacctatgaacagaaccgaaattaacaatttagaaatgtgaaagtgacataaacttttactttcaccatttttcacagggtcatttgttggtaaaattatctcctgtacttgcttcttgtcttactacatcagtcacctgtgaatttaaattagaggcattttgaaaatataattagtaagtcattgcttggatctattgagtagtaaatttatatttttatagtacctcagatatagtgtgaaactttgaataattcatttctcacatgaaataggcacattacaaatatccagcaagttgtaattctgggtaagagtccttcaaagaatgaagaacaacagttaagctgtacctttggtcatgcatggcaatatgtaattactatctgcaggtcctcaagatcaacttaatctctagtatgtaagtcaaatgcctgttgaactgtacagtataatacatggataaacaatccaaatgactcattttataagtaggtaccactttttataaacagagcgttttataacaacctgctgttggtggtggtggtggtggttttgttctcctcctgtttcttattctttattattgtcatcatctatacttactagatacaggaaaaatgcttttacaaaaatgacccaattcagtggtgctgaaactctagagacatcagaatcacctggatggcatgtcaaaacacgatgcatggtgcttgcctcagaatttttgattcagcagacataatgtggaaccttaggatctgcatacatagcaagtacccagatgatgctgatgctgctggtccagggaccacactttgagaatccctgctcttgtaaatgcttctttgtttcctgatctagcccttcttctatcattttaatgctaattatgcccaaaagtatagtagtactgctctttgcgtctttgcacaccaatctctgtggacaatctcatccacacgtgtggctactcacaaatataaatcaccagccctaatctccttttgagtgtcagactaatatatcaactgcctacagcacacctccacgtggaaatcccacaggatctttaaatttaatatggctggctgggtgccgtggctcacgcctgtaatcccagcactttgggagtccgaggcgggtggatcatgaggtcaggagttcaagaccagcttggttaagatggtgaaaccccatctctactgaaagtacaaaaaaataaaattagccaggcatggtggcgggcgcctgtaatcccagctactcaagaggttgaggcagagaattgctcgaacccgggaggcagaggttgcagtgagctgagattgtgccactgcactccagtctgggagacagagtgagactcgatctaaaaaaaaaaaaaaaatattaacatggccaaattggatctcttaagtcaacccccatgaagattgtttcaatcaagaattgtcgcattttcatgaggagcatatttttatggtcttaaaggatccccccacaaattacttattagttgcataggaaaaataataactatacattgaggaaattgaagaacatcttggacaaggtgatcaaaaatatcatcaccaaggaggggcaaatgagcatcatgtaatgccctaagatacattacctcattgctcttaaagcatgacccaatacattacctcattgctctttaagcatgacccaaacccatggcctaccatgcaagtctcctcctttcccagcctcacttctcctcaattcacacctcacagtcagctttacagttttaccaatacacctgagtattgaagaacgtgccatattctctcttgctttagggtctttattcctgctatttcctttgcttggctcgccttgcctcctccccaagcaccttctgtctctttgactagtgaaaacccatggtccttcaagactaaaattaatattatcttttcagagaaaacttccatgctgattcccctttcatgagtggtttaacagctctgtcctgcttggggcctcctagcacttaccacagtttattataatttcttacttgcttctctgtttcctggcttgcctctgagttctgaaaggtgggaattgtgttattcaccattgtttcctcagttcttagaatactgttaattaagatacagttccttaatgaatggatggatggatggatggatagaaaaaattgaaaatgtcatgcattttaataaacacattaagtgtttatttttatttggtagaaaactgatggaggaaatgaacaataatgtttagttttatatttggtgctgagtcctggataaagacaattgaatatgtttggtgttcatctaatttgcaattcaaaaccaccacgtgtagggaccttttctgccttactatttaaaatagtttacaaaattttgagaaaacgtagttttaattttacctagaatctttttttttttttttttttttgagatggagtttcactcttgttgcccaggctggagtgcaatggcaccatctaggctcaccgcgacctccgcctcctgggttgaagaaattctcctgcctcagcctgccaagtagctgggattacaggcatgtgccaccacgcctggctaattttgtatttttagtagagacagggtttctccatgttggtcaggctggtctcaaactcccgacctcaggtgatccccctgcctcggcctcccaaagttctgggattacaggcatgagccaccacgccagcctacatagaatcattttacatcagtgttttagatatgaatatttactaatctattatatttgatagcaaccataaatgcttaaactcacaattttttgtttttatgtgtgggaaaatttaaaaaacaaagactaaaaggatatgtataacaaaattttatctctatattgtgagattaatcttctctttgtattttttaacttttctaaattaatgtgaattaactgtatatgcagaaataatgtaaattttttttttttttttttttttttgagacggagtctcgctctgtcacccaggctggagtgcagtggcgcgatctcggctcactgcaagctccacctcctgggttcacgccattctgctgcctcagcctcccaagtagctgggactacaggcacctgccaccacgtccagctaattttttgtatttttagtagagacggggttttgctgtgttagtcaggatggtctcaatctcctgacctcatgatccgcccgcctcggcctcccaaagtgctgggattacaggcgtgagccactgcgcccggccaatagtgtaaaatttttacatagccaatgtttgctatgaatgtggttttctaaagaaccctcatattttctatatttatttgaaagggaagattttgggtttttcaatcgttttctgaccaactatcattacatttttggctgtaaagtgaattgatacacaaaagtcttggaagcaatttactacccacccctagctctggtattcttacgagggatgatacaaagacactaccttttctacaagctcttgtgtttacaagcataagagaaaaacaatatgtttaaggtattaattacccagaattcagcagtacattcctttgatttttgtatacaaatgctaacatatcacgaaggggaaagtgttcactgttttgtattggcatttaaaaactttttatgtatcatttataattgtgagagtaaatctgtagttggcttcttaaaaattcttgattacattggttctttatccacttatttatgttgatccgatgacaaagagttgttaataagtcaagacattttaacttacttattgacaagctaactaagaaaatagccaaaatagaggtattacaaatttcttattcaactcagcatgttcactgttcacttagccaaacattctccaactgaagaactccaaactagtttactcttcatatgactatattgagcattaccttactttaaattgtgccacttaatagtgaagttcggtgactatttcagcattatgatggatcctcttggactaagatacaaaatttacagttaaatttggtatttgccatcataaatggcccagattagctggtccttcccctatcactggagaggagtaatagtagctggaacccagaaacccagtgggtactagtttcctttctctatcccactttactcccctttatctcctttgcttacttcaagttttaaaaattacttacctggctaaccatgttttaaaatacattttattctgaaaatgtgaaagcattcataatacggattttttaggtcaaacttgccacattggtgatagttggggattgcggctgatttgtcagatgtatcttaccattggagtctgtgataattaagagcagtgttggactgtggtcatgtcagacactgcggagaagaaaaccgtgttttacatgcatattcagctgctgcatgatgtgttactgcatttcacattacatatagtagcccagtgccaactcactgcagtaaatctcagtgctaggctcttgccatttgtcatagtaacagaaaaacatgtgcagttttccattttattgaatgaatttgaattcatagaggacatcagattgtgctcactctctagtttatatgcctgtgtgtgtgtgtatatatatatatatatgctggcaatacaaataagctgaccatcccaggcagactaatcgaagatcttgtctaatattttggaattgtgattatttctatttctctttaccttaacttagggtacttcatctgatcaccacccctctaaagtatagaggggggtatttttggctcttgttctcattaatttaaaagttctcaatttttttgcagaggaaaggaaaacctacctgttggctgttttgacctatccatttaaccagtaatgcaccacagttagcacttctgggactaatctggccctccaaccttgaatagggtttacatggcattgccttaaggatatgtagtctttctattcctctaaatcagtggctctcaaatttgacaggtgtcagtcacctagggaacttggtaaaaatacaaaaccctgattcttactccagtgagtctggccaattctgatatgcactaaagtttgagaaccactgctctagacactaaaacaaatcaaaacaaaaagacagatgatctgaccaaggtagaaatgcagacagcattgagttgtccaattggcctgctatccccgtgccccaggctacttttactgaactctctcctgctttatggctttacttgaaggcgacgttataagaaacagccctcccagtatctgtgaactgcaaatcacagatctctcaaaatggaatgctttctgtaagtctgatgtcaaaattcatttgggggtaaatttaagaaaatatattattccttgtagtgtaaatatttatgtgtttaagtgcagaaatgttaatacgcttaactctagggtgctgccctaaagcctgctagggttttttcaaaatatttgaaatgcatactgaattagcttccaaaatccaaaaaaagtccactttaataaacatcttagtcccaaagatttcagattataattataaacaatgtgcttattaatacagtcatatgccacataatgacattttggtcaatgatggaccacatatttgactgtggtctcataagattataacagagctgaaaaatgcctattgcctaatgacatcatattttctataatgtcatagtgtaacacattaccttttctatgtttagatacacaaataattaccattgtgttacagttgcctatagtattcagtacagtcagatgcagtactggtttgtagcctagaaacaaataggctgtaccatatagcctaggtgtgtagtaggctctaccatctaggtttgtgtaagtaggctctgtgatgtttgtacaacagtgaagttgcctaaggacgcatttctcagaatgtatccctgtcattaagtgatgcacgattgtggtgtgcttctggagaaatggcttatttttatcttgtggacattgaaaatgacttggcagaccatactgtaaagctctaagccaggcttttgtcttcccttgatcaggagctctgtgacgttattctacctttatctttttttcttggtatcttcctacctttttattggtattattattatccattataatgattttgctgagtgcatttactcgttggctttttagatttttttgaatgtgtataaactaattgcttcttcatttagttggatatatagggtgataaaaatagataaatatattacttgttctggggcattgtctgggggagatttagcatagttgtcctcagttgtctctttctttcatgccataataaaataacctctattgtgaggataatttttcaaaaggacttagtgtaatgagcatacatttttggctaggtcagatttctaatagttggcagcccaggtattagcaacctcatattctacttccctgaataagaagtctctaggagtatctatctaccaaaaccactcaaatccctacaatccaaagaattccaggcttttaagttatgtttctgattctaatcattatttattcagtaaatggttgtataaaagtgacacaccctcaactgcaatttcagtttccctgggggaaacaaggaccctgaagggaaaacttgtacatagtgttgctttcttgctccagatcactggctcagagcatgaaagaagtgaaataacaaaccactgagtttcccctcaggtcttaaactatcagcctggatagcaaacaatttttattgcaaatttgagtagttactatgctttaggtttttttttggattaatgcagtttattttagagctgttctgagtttatacaaaaattgcaccaaaagtacagagagttcctatacacaccttcattctccatcccacagttttccctattaatagcatcttgcatttgtgtggtaaatttgttacaattgatggacagttgtaatacaatatattgacatattattgttaactaaatccatagtttatgctggggttcactttttgtgttgtacaattctatgcattttgacaagtacatgatgtcatgtgtcaccattacagtatcatacagaatagttttattgccttaaaaatttcctgtactccacttgtttatccctccttctcccaacccctaacccttggcaaccagtgatctttttactgtctccatagttttgcctctcaagaatgtcatatagttagaatcataaagtatgtagccttttcagattggcttatttcacttagtgatatgcatttcaatttccttcatgtatttttgtgacttaatagctcatttctttttgctactgaataatattccatggtaaggacttaccacagtttatttattcattaacctgttgaaaaatggcttaaacttttggtcgtttccaccttttggaaaatataaataaagctgctataaatatttgtgtgcaggtttttttgtggctgtgttttcaactcatttaaataaatactttggagtgtgacagctggatcttatgggaagaatatatttagttttgttagaaactataaaactctcttccgaagtgactgtaccatatttgtttcacaccagcaatgaataagggtccctgttggtctatatcctgtctgccagcatttggagttgtcagtgttcaggattttacccaatctaatgtgtgccatgctttatttttaacatttaacaaatagaaaatttgtgctcatggcatttgtttcttccaattactaatgaatagcatcatggttaaatgggatcattaccctgcttctttttccacccaccttagcttcctccagagttcactgttatctcttctctcagcaggtctgtggttggctattcttgtcttaccagtttgctgttattcctgcactcagtttctgttcttgtatgtgcctctctagtgtctagcataaatccctcaggactcaaaaagtggtattaatatgtcagtgagtcctattctgattccatttttcccaaatgagcctcctctttcaggctcctttggtaaagttcttctaattccttgggtctattacctactttttatattgttatagagaatgtcaaacatattcaaatacataaagaatgatatactggactaacgtatacctatcacacagtcccagccaccaacaacccatggccaatagtgctccatcctctcccatttactttttctaaatgttgtattattttgaaacaaatatcagatatcatattattttacatattcatgtgaccaaagatatagagcaatgacttctttttctaacaaacacatagcattattatcacacctaaaataacagcaatcatttattatcatcaaatatctaaataatgatctcattaaagttaagatccaataatgtccatgtgctttgactggttgatgcatattttaagtctcttttaatctatgggctctccctctattgtttgccctgccaacccccacaatttatttattgaataatcaaaattatcctgtaaagtttatcttataatctgatatttttactgattgtatttccgagatgtagtttaacataatctctgtattctgtattgcctgtaaataagtagaacctccatacaggtttgacttattttgatgtgactactataacttaattttttgttttgtattaatgccagttcattactggttctctcctaagctaatcttagagggcataccagtgtatcaattcatgcttattctgaaatctttaataaagttgtaaatgaattatacaataaatttcacagtgtcaggaatctaattaatgaaatagctagattagaaccctggaccccagacttttacatacaatttcctttccctgtaagcactatgttagcctcatgatagtagcatgcctctttgtaacttttaaatatcctgcagcagcaaattgagaaacacatttgcagaacattccctttactgtgtaatgtggttcttagtagagaatttatttatttatttattttgagacagggtttcactcccgtcacccaggctggagtgcagtggtgtgctcttggctcactacaacttccatctcccatgctcaagcgatcctcctgcctcagcctcccaagtaactgggactacaggcacacacgccaccacgcctggctaatttttgtatttttagtagagatggggtttcgccatgttggccaggctggtctcaaactcctgacctcaagtgatctgcctgccttggccttccaaagtgctggcattacaggcatgagccactgtgctcagccattaagtcttacatttgtatacaactttaaattatctacgtaatgtcactgcatagtcatatagcttggtagttaagcatttgaactcttttttttttttttttttttgagacagagttttgctcttgttgcctaggctggagtacaatggcacaatcttggctcaccacaacctccgcctcccaggttcaagtgattctcctgcctcagcctccccagtagctgggattataggcatgcaccaccatgcctggctaattttgtatttttagtagagacggggtttcttcatgttggtcaggctggtcttgatctcctgacctcaggtgatcagcctgcctcagcctcccaaagggctgggattacaggcgtgagctaacactcccggctgcatttgaactctttattctaatgtctaaataggactcactatttagggtactcactgtgtgatcttttttattattattacttcatagagacaaggtcttgctctgttgcccattctggagtgtagtagtgtgattgtaactcattgcaactttcaactcctggcctcaagcgatcctcccaccttagcctcccaaagtgttgagataacaggtgtgacgcactgcacccagcctcactgtgtgatcttgaataagttactgagcctagtttctctgcctgccagatgagacttttactagtaacaaccttatgaatttgctttgattattcagtatggataatgtatggatgatgcttagtacaatgcctgggatataatagcaaatgttcaatatagtttggaactataggcagagagaagtgttattatgagaaaactgaggcagtgatagggttggggcattggcctaatattacatagctgacatgtactttcacataagagcctgtcttttgtgtgagaactgactctgtaagtgtctctactgttatgaaggcaggaacctacttaggtactaggctatgtgaaagaagctggtgattagttgaatctaaagttggtgatgcactcacattgccaactacacacagtcataaaatccattagcctattttagacggcttactgcttaccttggcctcagctaccttactgcttaccttggcctcagctaccttggcctcagctactgcttaccttggcctcaggatatttaaagactaagattgtttcagtttgtttaaaaaattacacacacacacttgcgctcacacacacacacacacacacacacacacagtgggagagtatttttgccaaaacgtatgaaataattttctcctcttcacagatattgaaatggtgatttgttttatacatattccacacaaggtatatatatgtaagggataatttttttgtggtgaaatttaagtaacggaaataacatccactattatttgggtaaaaattacaaaagcacttcatagagacttttttccttagtgtatgaaccacatttatcaggtggtacaatagctgaattaagttgaaattgttctaaaatatgcttgagattttcgtctttcttcaagttgtcctgaataggtagacagatacctgaaaataggaataaaacctaaacctctactttaaaatgaggatattttacctttaaatgtctatttcacttgatgaatatttaacctttttgttagttgacctatctaaaatcttaagttacttgaaaaatatattttcttgtctgtggcttcttaaatggtgcacatgtggttagcaagcaacagctattggcttgccaaagctaaaagttaaaatataagatgataaagttgatgtaatatgtgaccttttataagtcactttcccatttgaaattaaatgtgccagatttgacaaacttaatatattgaataggttaccctaatatttttgttgacttttagcaagaacactataaagcaactataaagtgttatttattttagcttttctaaataaaaatcactgaagcaattttaatttgtacatataactcttccttaaaatttaaatacctgttttacttcatgtgcttccatgccttatttcattaaattttcaaacacgtatagaaagccacatctacaagctatcagatttccctgagattactatattaaaacatacactgaatcagactccatttcttccaacgctgattcagcactttaaaaataatctttgattttatattaaaataacttatcaccctttactgcatgatatcagaatgacactagttatttcactacaaaaaaatgtcagtgatcaaatcttgctggtccacaaataactctccacttgctaatttgcattttagcatcaactgtaaatatgtagataaaagaactgacagttgacagctaggtataacttatatatatttcatacagtaactcaataataccagattaatatttaaaaacattagtaggccgggcatggtggctcatgccggtaatcccggcactttgggaggccgaggtgggtggattacttgaggtcaggagttcgagaccagcctggccaacatggtgaaaccccatctctactaaaaattaaaaaaaaaaaaaaattagcaggacttggtaatgcgtgcctgtaatcccaattactcgggaggctgtggcaggagaatcgcttgaacccgggaggcggagcttgcagtgagctgagatcccgccactgcactccaggctgggtgacagagcgagactccatctaaaaaaaaaaaaaaaaaagaaagaaaacaaacaatgaaagacattaacaggagtatggcagaataaagaaatgtcaaaatatcatcctttaatctttaatgttataatttgtgtttgaattatgaaggatatattgaataataacaaatagaagtatttcaggaagcatagaggtgctgtttaaacacaatatgaaagtaatgagaatcattttccaacacggcattggatccagtctcatgacagtgtaaagaaactgtgggaaaagtgctctgtattttccaggtgaacctggttgcccatctcttgcaaccagctacagaaggtcagccagtagcactggatttccatggtcactcatttctccattctacttgtagtctgtgtagtgagaggaaaacaaatgtgtcccaaaaacttggtttcacatgagaagttcttcaaataattttcacctttagaaaaaaaatttatggagcatgatgatagtcaggagggaagaatggcagtttggaaggtaaggcaagaagaataatcttgagagtttctaatgagaaaaataatggaaaagggtaaaaaaaaaatagagcagctatgttaaagtataatattataattattgaatagaactcaataatatataattctgagcactctttttttcttctgactttatcatacaattttatctttagcctacctttaccttaatttgtatattcttagccttaggttattgaatagatttttataaaccatttgttttagtcagcttttgcttagtaaaaatacaataatatacaatccccaaatatcagtgccttttaacagcattgatttacttctctctcattttacatgtggcagctctctatggttctgtgtatcttcttcattcttgagtccagaataaataaataacttctctctggggcaaggcatagggaaaagagcaatggcagaaacatgcaatagatttttaaaattgtatttgagtataatttgaaaaaataatataatttaccctaccaacaaaatccattctggaataagatgtcatatagtaacataaaatttatattaatgtatgtaaaagaataatattaaggttgaaacttaaagaaccatttagtgtcttagtcaattttgtgttgctataaaggaatccctgagagtggataatttataaagaaaagaggtttatttcgctcatggttctgcaggttgtacaagaagcatggagccagcatctgctcctggttagggcctcaggaagcatccactcatggtagaaggtgcaagggagcaaacataatatggtgagagagaaggaaagagagatgggagggaggtgccagacttttttaaacaaccagatctcacaggaactaggactagaattcactccatcctgggagcattctccaagccatttatgaggaatccactcccatgacccaaacacctctcactaggccacacctctaatattggagatcaattttcaagatgagatttgacggggacaaatacccaaactatatgaaatggttagcatcattttcacttattaaaattttatcaaacatctacgatacagatgataccaggaagaagcaaagatgaataaatacctgtactctacatttaaaattctctggattcagtgaggaatatagcaaaatatataaaaccaatatagatgcatccactgatgagtgctttcttgaggattaaaagaggtgctaataagcagaaactgtgaatgaaactgtcaaccactgatacctagaaaccttaggatagtttctgtgtaagaatctgttaaattatctcagtccattcagactattatagcaaaatactctaaattggatagcttatgaagaaaggcaatttattgctcacagtcctggaggctgagaagtccaagatcaagtcaccatcagattcagtgtgtggtgagggctcgttctctgcttcacagagggcaccatcttgctgagtcctcacatggtggaagggcttcatcagcctcttttataagggcactaattccatcgatgaaggtgtagcctttatgacctaattacctgctaaacaccccatctcttaatactgttacattggtgattaggtttcaacatatgagttttgagaggacacagtcagaccatagcagatgaggataataataaagatattaatagtaataataactatctgtcttatgcatttactatatatcaagtactttagaaacctcattgtactctcacaatgaatttttgacataaattcaattattattctcattgtacagatgagaatataaaggcacagacacatattgaaagactatttataaagcttgtagtacctgagtggattaatggtgtttatattcagtttgtaaaacaaaactattatgagattatatatatatatatatgaatgaaaagtttccatgcctgttttcttgcaatattgattgtgaatgttaccgcagcctaagctcataaagcattttcttaacagaagcaatcacaggctatttgcaaagccatctcaataaaacttacaaacatgagtcctaagggtagaatcaattggtgagatgctacatttctttgtttgaattattggggaaaataaaacagtatgaaccattgatggtgttttgaaaaatatttttacactctattacttttattcttacccttaatatgtagttctatcattattttccatagaattaatctccactcttacatatattctttatgtaaatgagaaataaaatttcaaaggggaaaaatgtaagtagccaaaaatttctacataatgctttattaatgagcaaaattggggcattttatcttctgggtgagaaatgtaatattcaggaaaagtgtggtataattaatcatagtttatgtatttattactctagggttctttttgtaaatgttccatagttctttagcagtgaactcttctctaagttgcaaacagtacacctctattgtcaaaaaaggaccaatttctttgtttgcagcatattgtcaatatcaaatatgcatgctgaaagacagcagactatcaatagctagtaaattcacaaaaccattgggtgatatgctaatatttcacaagacaaacagtgaagggagaatattgtagtaatatttgcaaacaatattttctttagttttgtatttaaaatatgtcatttttttcttactcttgtgtgacttctttttcagtcagaacagaaaccttaaaatagataacctttgatttttatatttattccatttttctctgacagagtatggatgaatagcatgaaactagtcaaaattgctaagggaattaatttatctacaaaccttgttcaatcttattatttaaaaataacttttattaagataaaaattactaaaaatagattagactcttatgatgcacttagaaggacagaagatcatttctctgatagtcttgcctcaagttacaacctgattctaataaggagaatgcattagacaaacccaaattgagttacatgctacaaaatggctgaccagtactctgaaaagtttctaggtcaggaaagagaaagactgtagaactgtcacagtttggaggagactaagaagacatggcaactaatgcaatgtgggaacaactggaccttgaatcagaaaagaaccctagtggacaaactggttttgaaatttgaatacgtactatagatcagttcatcatattgtatcgacgttaatttcctcattttaataattgttctagggtttggaaaatgttaacattatggcaacctacctgaaggatgtgcagtaattattttctattcttgcatgttttctgtaaatctaaaattatttcaagatgttagagaatttttttttttttggagacacagtcttgctcttgctctgttgcccaggctggagtgcagtggcactatcttggctcactgcaacctccacctcccgggttcaagcaattcttgtgcctcagcctcccaagtagctgggattacagatgtgtgccaccacacctgactaatttttgtatttttagtagagacagggtttcaccatgttggccaggctggtctcctgacctcaagtgatctgcctgcctcgacctcccaaagtgctgggattacaggtgagccaccgcgcctggccaaaatgtcaaagaaatatttttaacttcgggagcaaagaagaactccaatctctggaatcagaaaaaataaaatattatttttatttgaggttatttaaacctcccatggagtatattaatatctgcaaactgagtgcctgctacgcaaggctacaaggtgctgtatgagacggaaacatggagacaatttattttttttattattttatgatgacatttattaagcttctaaaattatgtaacaaaatgaaagacatggacaatcacactttttgatatgataagaaaagagattatttgaatctgggacacagtgttccagaatttagaagatccatacaaagtgttgaggagaatctgattctaatttagggtttagggggaacaaagatacagtagttcccccttaaccatagttttgctttctatggtttcagttacctgtggtcagccacagttcaaaaacattaaacagaaaattccagaaccaaacggtgcacgattctgagtagtgtgatgaaatctcgtgcagtctccctctgtcctgtccaggacatgaatcatccctttgtccagcagatccatgttgtatatgctacccacccatttagtcacttagtagcaggctaggttatcagatcaactgtcatggtatcgcatgacagtaatccttattttacttagtaattgttccacagcacaagagtagtgatgatggcatattgttataattgttctattttattattcgttgttaatatcttactgtgcctaatttacaaattaagccttatcacaggtatgtatgtataggagaaaatgtattatagatcaggtttggtgctaaccacaggttcaggcattcactggggatcttggaatgtattcccgtcagataagagggaactacgatatgtcgatacaacagtggttgaactattgagtcatgcttggagctcttgagtatgaatatcaggaaataagcctggaattaatccaattgtggccaatttttaatgccatattagggcacttaaccttcattgtgtagtcagtcttaagtgatcaaataaaccacacaattggttctatggttcacaaagttaatggcgatatcaagtgaaaattggagtgaggcaagatgggtttccaggagaccagagaggcaacaagggctatataccttaagagcaatttacaaaagattaaaggagggcagtggcaatggggatgagaacaaataaaaaatagcaaaaaataatatattgaacttattgtaattatgtcaagctactgttatctttaaaggtaggaaaataaagatcttggctgggtgcggtggctcacacttgtaatcccagcactttgggaggccgaggcaggtggatcacctgaggtcaggagttcgagaccaacctggccgacatggtgaaaccccaactctactaaaaatacagtaattagctgggtgtgatggtgggtgcctgtaatcccagctacttgggaggctgaggcaggagaatcgcttgaacctgagagacagagattgcagtgagccgagatcacaccattgcattccagcctgggcgacaagaatgaaactcagtctcaaaaaaaaaaaaaaaaaaaaaaggaaagatctgaataaataatctcctttccttaatataaattttaatgattacaattacaactaattgatgagactggccagaggagtaaggcatgttgatcttcttttttttttttttgagatggagtcttgctctgttgcccaggctggagtgcagtggttcaatctcagctcacttcaacctccgcctcccgggttcaaggaattctcctgcctcagcctcctgaggagctgggattacaggcgcgcaccaccatgcctggcttatttttttgtatttttagtagagacagggtttcactatgttcaccaggctagtcttgaactcctgacttcaagtgatctgcccgccttgacctcctaaagtgctgggattacaggcatgagccaccatgcccggcctgatcttatttttaaagagtgtaaatgtaatctaattataaatttaaactttagagagaatgttgagagatacggacataataataaaaaaaacctgagccggataattgtgcttgtctgaaatgagctaatgaaataattttgttcatatcctttgggggtatttctgaaaatcagtaaagactatgcacagccattttatgtttttacaatagtgccattaatgatgccttatgagtgaagaaagttggatgattgggtgtaaaagatgtaaggttaatgggaaaacttccctagtccacaaatcatcttattatccagtctgtaattctttgttccatgccaaaaatctatatttcgtcaagtaataatagatgctttcaggcaaacagccttatatgttgaaatgcaaatgattacttttaccccgtctcctatgcttctccttaaacactgaagtgagtcagaagaaagaactcttaccctttctatttacactcactgctttggtggtatcactgaatctcatggctttaaataccatttgtcttctgatgattaccaaatactaatctccagctcagacctttctctccaacacgagacaggccactggactttcaataggtagctcaacctcatcctcacgtggtggaaagctctggattgtcccccaaaactatttatctcatcattcttttcccatctcagttaattgcatcgtcattcttctagttactcggcacaaaaactttaatgtaattcttgactcatatctctctcacccatcatttgattcatcagaaaatcctattgtctgtaccttcaaatcatttccaaaatctgaccacttctcaccagctccaacgctagcatcctggtcagagccacatttcactttgcttattgcaagagcaccctaactgacttccaacttctgccttgcttcccatcaattcactcttaactctgctgctggagtaattctgttaaaacagagattagtatgtgtcacttatttgctcaaaaacctccaaagacctctactttcactgtgagaaaaggccagaatacaaaattacaagggtccgtaaggccccagaaagacttgacctggcctgacctcatctaccgctacctttccctcttgctcactcttgcttattttcagcaacacaaggcttcttcccttttcacaatcactgcaggaacactcctgcctctgagactcagaccttgctctttcctctagctgaactgctcttccaaatgccttttttgttcactccttcaccttcttcaggtcttgacttgaaacaccctataaatagggcatttccaggccactctaaaattgcaaacttacctccattccttgcaccctttccctccttacagctgttatcaccatgtaatttactatagtttttgcttacttgttttttatctcttacgcaaccatcccattagaaagtaaactctattaaggcaagaatttttgttttttcaggactctacactaaatctcataattataagacaatatttggtgactaattttaataggaaatattgcctagagtaagtccagattttcttcttaatttaatcattaggcaaaatattttgagcaccttttatgtacttgattagaacataagggcataatgcattttaggatgtctgagattattggggagtaggcatgaaaacaagtattaatggtccattgttacaagaaaaagagtgaaatctgggctgatgctctctagtttgagcaggaaaatatctcatagcctctaaccttacttaaattctgccagctctggcctgtagaagcagtgaggcaaaatgacccactggaagaagctacttcttttgcagaagcaacctaactctgagaagaaaaaaattaagcctatcatcttcagttctacttgagatcttaattataaaataaactcagatttctatttccagttcagatggtttggtataagatgggccataatccctgaaaagtggcaattccaaggaagtttggcacaagtcttaatatgcttattcaggctgaagttccagcagttccttcccataagcagacctgctagagtgtggaagacacataatgtaaatacgttaggagcaattgttgtttctttcattttcttctgaatcagtccacagcccaaggattctgtgaagtaacaaaattggctgttacagattatagccacattcccatcttaatagcagcagttgaaatttcttgggcatttcaaggtagagatttatgttttatttgcagttcatgattattctgattcaaatatctgtaaatataaagggagggggagaatgctaacacaaaaaatattgtacccagttaaactttatgtctgtattaataaagcagtctttgatttagaattcttagtccctttcttttagaggattgaggttagggtatgtgggtttgtgtatgttttgtcaccaaggttggggtgatattaccacagtgaccagaactataaccaaattcccatttatactagtgatggttgtatcctgtctaccagagaggggaaaaatgctttgacaaattcatcattgttatgttttcttgccacagtttattctcttctgcattctgtggaagttcttttggccctgtggcttcctcaatcataagctaccacatacaaagactattttttcaaagaagccaattagttttttactaatcatacgaacttagaaaaatagatattaaatattactgataaataacacagccttgtcagaaatctctcaaagtgtgtgatcattgtctatagagtagaactttttaggggcaatacagtactgtttttatattcaatgaagataagttagattaaaaatgtaagatatctttttgtgaattgccacatggtagaattttgtaagaggtttttataatgctattcaattacttctccatggaagaattttgctcacagagaaagagagacagtgtgtgtgtatacacaaacatatataaatgtacatatatctgcatgcattatatatgcatatattgtatgtgtatgtaaagtatgtatagacatacaaatacagtcatatatacatacatatatagtctatacataatagctatatgtgatatactctctagatgttataaaagcttttcaaatttcaacttattggatttgttttggtgagtgttcaggtttattggtggaagaattatgagtttataaatcactgattagtcctctattctcacaagagtaaaagaatattttaatgatacatagtcaccaagggattgcacattttcaaatgaactcactgttactgcccctgttgtcaagatggtatctccctctttctcctcggcaaaaacaccatgaatcaatttatttagagtgaaaacaaacgtcaatcattaggtgaagatgctttttctcaatatctaaatggtttaaaattgaatttctcacgtaactgcccatttaaagactcaaacatggttctttgtttttgaggaatattctttataaagtctctgaaaacacttttactctcttagcaagataccttctttacttggcaacaaaaaccacattgaaacaatcgtattcccttttgtcagcctgagccagctgaaatctttggagttatcaacctctgccaacaacttgaagtagcggttgcacaatggataactgagatgtagtttattccaagctaatgattttctgaagctttcgggatggttatatttatactgacagatacagacctaactttcccataaaaagaacagactgtgttcaacgtacccagataataccagcctcttttttgtataatcctttaatttcagatgcttatagctgcttcagtcctgtcaataccagcactctgaagtcttgccctgcttgataatcatttgtctctgtaatttctttatcattgctttacttagggacaacacaaataatctatttagaccagaagagaccaactttctttcttctttatgatcaaaatattttgtagactccctacaaaataattatgataattgtagtagccattgggtaagaaatgcataatgacaaaaatctagttttaattcagtcgtgctaagcatatactctgctttattacatcagctacatatgtttaaaaatactaatatatattatttatctagtctgcatttggacttgcctaatcctttcaactagaatgccctctcaaagatccgtatcttgaagcacgagaaccaatagtttgaaacaactgatataaagtggataacatcaggtgtccaatgacctaccacatttgacactgaaaatattttccaaagaaatacagagtatgaaaataagaaagaactactctatcactcattgtcccatcgtctgatggccctgttgactcattgtacaccaagggccttttgaagtagggaaatacatgtgaccaatagagatagaacaataagacaatttcagatttgaaagaaacctgagcaaccacggagcccaaccctctctttttctccagtaatccaaagaggtcaagtagcttgttaagggcacccaagaagttgatggcaaagccaggcctaaacctggattatacaaacttgaaactatcttgaaatgtagtaagcactatcgcagtgttgggtaatacccttacactcaatcccagaagattgagttcagaagatgaagatgtggaggctgaaattataaccctggggattcgttgattgtgatgtactttatgcaggtttagaggcaaaaacacatggcttggcatcagaagtggaaaggaaagtagagtgttgtagaatgagtgctggatttgaggtcagaagacctcttttaattcccggtactgtcaccgattagatgtgacctatggcataacccttaaatatccttgacctcctctgtttccttttatgttaaaatgggaataataatgcatgctttgaccatcatttagaaaggttgagagaatcaaaatcagtatcagaaaatgcttttttaatctgtgcagagcttgaggtaacaaagcagtatacctcaataaatatcgttgcattcctctatgccaggcttcgtgcaaggcactgggaatagagcactgaataaaatagaaatgatcatagtttaaggaattttcattctagaaaataattacttaaatgtggctctatgtaacttaccaggagctttcttatccgttgttcctcttgagctttgcaacagtactaggcagacaggatagataagtaatgataataacaaaacaacaataatagcagcagcagcagcagctaacatttctattatttcaatgtaaaaaaagaatttcagattgtttaaatacagaaatgtggtggagtagaaagaaggccaagatggggacaaggggaaccatgaccccaaaagcaaataaagcatctgagcattcctttctgtttggttatgaacatctgagggtacataatcataatgagctcctttcagtaaatacaagatgggtgtttccatcttgatattataaattaagaaacaaggctgggcgcggtggctcactcctgtaatcccagcactttgggaggctgaggagggcagatcacgaggtcaggagtttgagaccagcctgaccaacatggtgaaaccccgtctctactaaaaatacaaaacttagctgggcgtgttggtgcatgcctgtaatcccagctactcaggaggccgaggcaggagaatcgcttgaaaccgggaggcggaggttgcagtgagctgagatcgtgccactgcactctagcctgggtgacagagcaagactccatctcaaaaaaaaaaaaaaagaaaaaaaaagaaacaaaagcacaatatgatcgtgtgacctgccctagatgctaaacctaatgagcagagaagcaagcaaagattgattccaggatttcctggctccaaagcctaggttatctccattgtatcaggctccttccaccacatctggatgttgactacatccagaacatgaaacaaaagcttcagtgctaaaaacaaacaaacaaacaagcaaaccaaactatcacattaagaagcaagtcaccaactgatcattttctgattttgctgtttccatggatggttccaaaatcctacctaactcatcaagcttaaatcaaagttgactcatccttacttgtcatcccatgtaaaataagttgccaattcctatctgtttcactttcaaaatgtttttaatcctgctgcttctgtgtagttttgaactggatagttctaataattgttgccaaagttccatactagcatctctggcttggactccttacatgctgaatccaactctcttagtttgcatcccctcactggcagatcctgagacaaggctttaagtgctggtagtttatttggagcatgaccccccaaacacaacagtctgggaatgaagtgagatgggaaaaggaagctgaccaataaaaggtgtgttatcaagaaagttacaactgtacatagctggaacttagtcctaacagagaaccctaggaaacaggatagagcatctgacttggagttattctaactgaggatcaaaagagcatcatttatagactggttcccattggttattggtttaggctacccccaagaactttttggtgttgaactcttcctgcgtgtagtgcaagtgagaagagaatgcttctgcagccagggaaatccctcagatgaaaggacttagatatgaaagttggaagtcagagttcagagaaaagatactggccaggggagtttatctgggtcactgtatttgctctgccagcctatatattatttctaaattaatcttcttagtgtacatctgtattagtccattttcatgctgctatgaagaaatacccaagattggttaatttataaagaaaaagaggtttgatggactcacagttccacatggctggggaggcctcacaatcatggcggaaggcaaaagaggagcaaagtcacgtcttacatggtggcaggcaggagagcatgtgcaggggaactgccctttataaagccaccagatctcatgagacttattcactatcatgagaccaacatgggattaaacccatccccatgattcaactacctcccaccaggcccctcccatgcataacatgggattatggaaactacaattaaagatgagatttgagtggggacacagccaaaccatatcaacatctttgctggagaaagctactctagctattaggctactcagagtatgccttgtgactttcatccttcatgcctttctcatattgtctccttttcttgattattgttttcagtcttaccctactccccgtcccacatagtcaaatgttacctatttatgaagactcacactgtgggcatttgtgattacatattatttttaattacattataacttgatgtaatccactagcacagtgttctaaatataatagaggcctaatggatgtttttggactcattgtctgacaacataacaacttgtgattgtctgaaaatgtaacaacttgtgattgtctgaaaatgtaacagcctgtgaactcttcgttgttcaaagaaaacagaaaaattccaaatatgtaactctttgaaattatgtcaatgtagatttgtttcaaatgttaatatatagtaaccagggaataatagcaatgaatttgttcagttacgatatttggtacttccaaatagcttcccatgatgaggataagataactaataattcttacagtaaaatattctttgattgggttgtttcctattgctgctataataaattaacataaacttagtggcttaaacaacccaaatttattatcttacagttctggaagtcagaattccaaaatggattttactaagctaaagttaaggtgtcatcatggctgcattcttttctggagactctgggagagaatctgttttcttgccttctttggcttctagagactgtctacatttcttatctcttggccctcttccatcgtcaaagctagcagtagccagttgaatctcacagagcatccctttgacattaactcttctgcctccttttctcatatttaatacccttgcgattacactgggctcatctggataaccctggcttatctctgtatcataaagtcagctaactagtagtcctaattatatctgctacgttaactcccctttgccttataaggtaatatattcgcaggttcaggagattaggacacagatgtctttgggaggccattattctgcctaccacaattgatatgtcccactcttccctcctaatttaataagacaatcctatactggtttacccttatctcgtaaaatattcaagatgtagtacagatgttcttgatgctagatgttgaattatgattttaacaaatggaggcttgtgtctcataatgtatatttcgttttgaaatagaaaagttgacttagaaaattagacttccatgtgtacacataatagttctgctacttgagatccagcgattagcctacttctagcattttcaaaataaacttgtcatttgtgtcattatcatagctgattagaaagtaaattatttgtattgaccacattgagaaaattaccatttagcttatggaactctttgtcatagagtgtggatattatatttgtacttgattctaatagtggttagggacattagaaggatatggagctcatcattcaactaagtccttacaaaataattcaatctctgttttagaagtttatcataatattagtacataaactgaacacaagaaggaatttataccatagaaaaattagagagaaaacttagaaaccatctcctacgagctctttgcttttcttgcgaagtggctgctatcaacagaaagagccgttgttaggctttgcatgttctggagtgacatctattagagaaggtttatcatctttgaccactttgcacttcctctcccaacaaagccttacaagcatgtgtttcctagagtggccacttggatcttcatcttccagtaatgttcatgatttgggtattcctagttctctctatccaaaatggccagttggtatcttcttaacccagttgtgcattttaaaatattttgtgggccaggtgcggtggttcactcctgtaatcccagcactttgggaggccgaggcgggtggatcacctgagatcaggagttcgagaccagcctggccaacatggtgaaacctggtctctactaacaataaaaaaattagctgggcatggtggcgcatgcctgtaatcccagttactcaggaggctgaggcaagagaatcacctgaacccaggaggcggaggttgcagtgagccaagatcatgccattgcactccagcctgagtgacagagtgagactgtctcaaaaaaaaaaaaattgtggagtccaaactgttactagttaatctggaaaattaatctataaaaagttcctaataatttatactattttttcttcctgtcacaatataaaaaataaacattacctgttgtaatctgaatatgtgattgtaaaatgattaagcccgatttttcaaccaaagagattatgacttaaagtgtttattatgaagttcgtggtaaatgaagaaccagaatgtataaaggtgattcagctataaataaaatttaattttgtgttaataaaagtaaaattagggaattatgaaaagatattttcaaatacaaagatgcatttaatattcacacaatattgatacttagtacccccatttaactaattaagaaattaagactagtaatgattaagtaactttcccacaattacttagctggctagagtctaacatggtatctttttctttctttctgtcttttttttttttttcttgagacagagtttcgctcttgttgcccaggctggattgcaatggcatgatcttggctcactgcaacctccgcctcctgggctcaagtgattctcctgcctcagcctcccaagtagctgggattacaggcacacgccaccacatgccaccacgcctggctaatttttttagtggagacggggtttcatcatattggtcaggctggtctcaaactcatgacctcaggtaatccacccgcctcagcctcccaaagtgctgggattacgggcatgagccaccatgcctggtgaaacaaacgtggtatctttttcataagaggaactcaaacattctattgagttgaaatacattgaatgaggcatcctttgttttttgcactgaataagctctggtgagagctctattgttgtctttaaataagtctattcttctaggactggctaaaagcccacttaaatgggagccctcaggtacactcattgtcttcattaacttcctttgttagaaacaccattcattcaacaatatatccaccaaaaatattcagaagtggatgacctttcttatgctgatttttgaattgtagaaaattgcggagattcttactaagttttgggatagaactctctctcactggtctttcctttaaatataaaatagaaccttgaatatggtaatttcaaatatgcatgcttttaagtgaattgtaagtttcttgcaaacagggattttgttacagtctacctttattctaacaagataatagtagctaccatttcagggcgtgtatgtcattaactgcttcataacacatgatttgacttttgcttttatatttctaacatttataagcagtacaatgtaatagtcacacataaatactttataatatttatcaataattaaaaataaattaatacaggaatctaataatttatagtatatgaatttagaattcattatttatattataataaatatacatttgtaattcattattacattatttatttattgcatctaccctcttgacactatttcaaagtgtgcataagtattgcactttggctttgagaaatctaaactaagaaaagataagcaaattttccaagggctcttagctagcatttgacaaaggaaaaattctaaccctggtctgtctgactccaaagatggattttattcctttttagtgtgctacattgcttgcaattttccatgagcctagcaaagtgtatcctgttggattgaagcatattttcgagtggagatactgtggtaaatgagatggaaggagaagatggtaactgggacacctactgaggtgtgttcttagaaccaaagacttcgacttaaactctatcatagatcacagttggtattagattcacttagaagaatataaaacacaaatgaacattatgtgtccttcctccttgagaatagtcatcacacaaatctatgtagcagttcccacagccatctgggtagttatctttagcgattcctttcccccatgtctcacatcatggaatacgaatcacattgtgtaggtgtagaaatcacctgggcgtaaaaacctcattccccagtagccagtatctcttatatcaaatctgtagtcacagcccctgaaaacatgctcagttgcaagtcatcacactcagggaagtgcaaagatatgacatccagatcaggcatctatacttcatttatagtttcttctagttcatgtgaaacttaccaatcaggactcatttttatcatagccagtatgaccttgtaacacatttgacataccacgtttatctgtcttcaggggatcagaactaaaaagttaccaaagatccaattttaacacaggtcgaagggttttgatagccttttacccaaaataattacagaatggatttcttgaaaagtagttttgaggattttgttctatttttaaggatgggaggatttggatatgacctcaacagttggtggctgagaaagagtggagaaaaagatccttggagttaaagagataagagaacagagaggctagaatgttagacagagcccctttgtatatgttgaaataagcaaaatgtggacatgtgggtaggtgaatgggacagtgatccaggctctaaaactcttactaaatgagagaaaatgacagggagatctgtagataactatagctttgagggaagatgggtgatggtggctgatggcacaacctcaaatgagttccttttattgaaagaagacaattcatttggaagaagtaattgggagcaagggaaacacctactctatctctaggccctaatttttctcatgataattcattgaagtgctgtaaaatatccaaacaaagtaattcagtaataagggaaaaaacttaaaaatatacacacaaatttataaatgtcatgtgtatatatttgtcctcaatacaatttctcctgatcagttgtgtgtaactaggatgtgtaataaatgaacacaaggacaaacacactgcagatatttaccctaaatatctcagtgtattttaatacatggaatattattgtgctgctttgttagtggggtataatttaggggggatctttcttgatagcatagcagaaattgatctgaatcctaaatactccatttattagctgtatgactttgggcaaattagtttactcagcctcagattcatttctcaagaaattagcccaccagtatgacttacctcttaggattatagttaagattatatgagataaagcacatgaagattttagctcagtgactagtgtagtaaatgcttaataaagctattattgtcattgtaattacattaaatcacattaaaaaatttagttcccctattaaatcatatgaagagtttaaagaaagtcaacggggtaatgtgttcagtttcttttttaaataaaaagtatgcaatattataatgattagagtcccatgtagtagaaggaagagaataaaggactgaaattataagactatttgtgcccttgattttaatttcttaccttgagtccttttgttatttagaatgaccccaagggaatcattccttatttgattagcagtgctacactttaaagagcattacttcccccttatctcactcccattccaaagaccactagggtataaccgttgcaaacatttgtactttgtctaactacaggaaaacataggaaagggtaccttgcattccaaactcaattttaaatcactggtaatggttttgactggctaatgcaatgggaacacctccaatatatgttggccagtattaatcttagcatagaaaatattcacttttaatttgatggtcattttttttctttttttggaggcagagtctcgctctatcccccaggctggagtgcagtggcacgatctccctcactgcaacctctgcctaccgggttcaagtgatactcaagtcttagcctcccctgagtagctgagattgcaggcacctgccaccatgcctggctaaatttttatatttttagtagagatgagattttgccatgttgaacaggctggtctcgaactcctgacctcaggttatctgcccgactcggcctcccaaagtgctgggattacaggcgtgagccaccactgcacctgggctggtgctgatatttagcaatactgccatctgtggtgttcatagaaacaaaaaaaatcctccaaatactgcttaaaggagtctcatcacacttgacacacatcttttaaaaatttgtgtttttctattgctctttcatctcaaagaggcctatagcagagaatgagtagcacgttgcgctgtctttggggtcctggataaacaacctctttcttttcttttttcttttcttttctctctctctctctctctctccccccccctccctccctctccctctctctctctctctctctttcctttctttctttgtttctttccttcctcttctttttttttgagatggagtttccctcttgttgcccaggctggagtgcaatggcgtgatctcggctcactgcaacctctgcctcttcatttcttcatctgtaacaagagaataaaaatgacttcttcacagatttatataaataatattttaactaagtaattcattttgaaatgtttatagaatgccatttacagataaggtagaaatagagtccttcctaaaagtctgttttagataattaatcactaaaattataattggagttgtcataatcaattatgtagcattgtttcaatgatgttaacattgctctttttcactggataaattgttatgtggcatgtcatcattctaatattcagtttacatgacacttcttctttaactctcctctgcagatattcaatctagagtttgtggcacagtatacataatttttggcagatgatagctaagtgcattgtataaaagatacattatttaccagatcaaaggtcaatgtgttcataatttaatatgccgagggtcatacagtccagaaatgtctgtgaatttctgaagtgacacacatttttgatagaaaactgccattttgtaatggatagcacatcaattggatagcccagcattcttttcagatttacatgtcaagttcatcagtgaggccctacataaatctactctaggattaatttccagatttcatctttaactgtatcacaattctttttttttgagacaaagtttcgctcttgttgcccaggctggagtgcaatggcgcgatcctctgcctcccaggttcaagtgattctcctgccttagcctcccgagtagctgggattacaggcaagagccaccacatctggataattttgtatttttaggagagatggggtttctccatgttggtcaggctggtcttgaactcccgacctcaggtgatctgcctacctcagcctcccaaaatgctgggattataggtgtgagccacagcacccagcctcttttcttcttaaataagtctttctcaaggaaattttcacaatattgctcttgggactcaatgtccttatgtggtaggacactacgttttctgaaaaattgcttattaatctggtatatgtgaactatgcaaattatgttttctattttagtctttagatgcagtagttttactattttagttttctcagatatattcacagcaaaagtactatcattgtagagtagtttcacttagcagtgaaagtaactctgctatgatgtggacactgcttctcatttttcttaataaatattatgtttgttatttttataaaatttgttcattagatatggagttttattccaatttaatgatgatagatgggttttatttttatttaattttactgttgtgttctatgaaagtatcttctttaaaatattgtgtaaagatgtcttaattttactaaaacgatagtaataataatatagatgatactactactaataaaactactattttctgaatatgtacaattgccaagcatgatttatgatttacataggatgccaaatttccattatatatcttcaaatttatatgttcattggtttgttcatctatgccacaaatgttaatggagtacctactaagtgccaacaactatgccatcaaccatgaatcagtcacttaacaagatagatataatcccttccttcagaaagcttgtagtctgggagaaaatttaacagttaaacaagacattgaaaaaagtgtgggccgggttgggtggctcatgcctgtcatcccagcactttgggaggccaaggcgggtagatcgcctgaggtcaggagttcgagaccagcctggccaacatggtgaaaccctgtctctactaaaaatacagaaattagccaggcaggcgtggtggtgcatgcctgtaatcccaggtacttgggaggctgaggcaggagaatcgcttgagcccgggaggcggaggttgcagtgagcagagaagattgtaccactgccctccagcctgggtgcaaagcgagactctgtctcaaaaaaaaaaaaaagtgtgataactgttttgatacagcaagtggatggatggaagaagctctatgagtatacagcagggatacatggcctgggaggaaaaagggctgaccatccattgaaaggtttaattaggtcagtgaagttgctcaagtacagctataaaatgaggcaatcaattactggtgatgcaggagagaaagtgatgtatggagaactttctgaactatagtaagaaatgtaatctgtattctaagggcatacttaattactgaaatagtgtattcaaaataggtatcataatcaaggaaacaatcttaaatcatcatgttccaattgcttgatgattattgaagctaacgtattaggaatagatgtattagctaatgtattaggaatagatgtttcctactgctgagttgaaataacgaacccacttgaactttcgcagacacctctaggtttaccttttatttaataagtaaataaaaatgttcatgttttctataatactttgcatcagctttcccttaatcttggaaacatttatttgactgaagaaattaagcactctcacctgcataaaatattcttctgtatgctatagtggagccagttgtaaagatttagttcagttaataaatatctgttgagatgctggcaaggctgtggagaaataacaacgcttttacactgttggtgggagtgtaaattagttcaaccattgtggaagacagtgtggcgattccttaaggatctagaaccagaaataccatttgacacagcaatcccattactgggtatatacccaaaggattataaatcattctactataaagacacatgcacatgtatgtgtattgcagcactattcacaatagcaaagacttggaactaacccaaatatgcatcaatgatagactggataaagaaaatgtggcacatatacactatggaatactatgcagccataaaaaagaatgagttcatgtcctttgcagggaaatggatgaagctggaagccatcatccttagcaaactaacacaggagcagaaaaccaaacaccacatgttctcactcataagtgggagttgaacaatgagaacacatggacacagggaggggaacatcacacacgggggcctgtctggggttaggagacaaggggagggagagcattaggacaaatagctaatgcatgtgggcttaaaacctagatgatgggttgataggtgcagcataccaccatgtcacatgtatacctatgtaacaaacctgcacgttctgcacatgtatcccagaacttcaagtaaaataataaataaataaataaataaatatctgtttaatttctgcagaagaccataaatatacttggtgtgtcaggcagtgatctgtaagtatttttgttcatgcaatcacaccaatcaaaattttgagcaaataccccaatatgtgtatatttttctaataacaaataatacatatattactatattaatatatagtatacattaatacctaaataaaatagagaattgaaataatggaatacaaataaatttttaaacagctgtaaatatttttctcatggctcaatcgaggaaatcttaaatatcgcccagggagtaggagcttattttgcataccatcacaatggggaaaagaaaaatgaatacactgttatgtctaccttcaaggaggcagcaatatggtaatagaaaagttcacaggggccaggcatggtggctcacgcctgtaatcccagcactttgggaggccagggcaggtggatcatgaggtcaggatttcgagaccagcctgaccaacatggtaaaaccccatatctactaaaaatacaaaaaattagccaggcatggtggtgggcgcctgtaatcccagctactcgggaggctgaggcaggagaatcacttgaacctgggaggcggaggttgcagtgagccgagatcacgccactgtactgcagcctgggcgacagagcaagactccgtctcaaaaaaaaaaaaaagaaagaaagaagaaaagttcactaaagctaaatgctgtgccctgtggtattagaagttagagctgttgtggttcaaagtcaggaagatattttcagggcaaatttacttgtaagttggggccaaagaaaggaaggtaatagggaacaaaggctggaaatacagcatgatggttctttagagcaatgcttctcccagtgtaatgtgtctttgaatcagctagaaatctgagctgcggcctgggagtctgcatttctaacaagctcctaggtgctgctaatgttgctggtatacagaccacactttcagtgtcaaggctttaaaggactttctcatctaaaatgaggagtttgtgcttaaattgataggcagtaggcaatttggaaaggtgttccagctcagagcaacatgatcaagttgaactctaggcaaagtaatttagcagtaatttatagattggaggccaagactggaggcagagagataagtctagaggcaattacaggtgagaggtaataagacctctgaagtaggacatggcagtagacacagaaaagggacatggtagaagcagaatcaacctgagaagagagataacaaaggaacacaggtataatatatagaacaaattaaaacgaagactagagaaactaatgagaaatgtgtcctttactgttcatctagtaatttggaaatttgaattttcatatatttaaatacatatgcataaatgatattttcagctaaccaccagaaaatttctggtagaaaatatcacaaaataaaactggctttgaatatgtttgtctttttccttgatccttatttccagaaagaaatacatgtcctggaagtatatgtccatagaggtccaataaatctcaatgattgtaaatagagctttattcatattgagcaaatgtttcctgttcacttgcctctaggtgaaaaacataaatgtctttatacaaatctctgaaatgtttgaagcataaggaaggtgaaagtggcaaggagacatgtattttcattataggctctgaatatccatagctgttttctgctatttagccacttcttcctttgtgacctgactttggacggcacacattatcaatcaggaagaccattatgttccttttacttgtacttgtcaatgtctggctgctcctactgcaagataagctccttgagagccaagactgtgtactattcattttgtatccccagatcccagtgcagatgctgaataattgacttataaataaatgtgtaaatgatcccagaaccaagcacagatatgaacacaaaaaaaattcctttggagtgaacgaatgaattaataagtaggcaagtgaaagaatgaatgttgacttagcccttagaatggccattgacaggttctgtttttttattactagataagcaccaaccttattctactcaaagtatgtgatcaatatttcactcattcatgtccacatactataagaagccttcacattatatagtgactttgaaatcaaagtctaagtctaaattttattataggagaaaaatgtgtgtgttgtgcattgtggtttagtataaatataagtcagattccttgacatcaaatcagttcaccattttttcactcacagactttttcgtcatccttttaagcctcccattttttctttttttaaaaaatgatttcattatactccattattgtgtatgtgtgtgtgtgtatgtgtatctgtgtatgtgtgtctaagtcaaaaactaacctcttctatgggtattttgttactatcctctgtaatataatgtgggaatctttgtccgtgagcataaacagggtgagtgcaggaatctagccatcagttctttctgtactatgcatgcacagcgtctaacttgtgcttgtaatttgtgattacgtcttcaggatacatagttttaaactaggccgagtgcggtggctcacgcttgtaatcccagcactttagggggccgaggcgggtggatcacctgaggtcaggagtttgagaacagcctggccaatgaggtgaaacctcatctctactaaaaatacaaaaattagctgggcgtggtggtgggcacctgtaattccagctacttgggaggctgaggcaggagaatcgcttgaacctaggaggtagaggttgcagtcagcggagatcgcgccattacactccaacctgggcagcaagagcaaaacttcatctcaaaacagaataaagtaaaataaatgaaaaaaataaaattaaactaacagctaactcacagtcttctgctaaaaaagtgtcatacattcagattgtttactctatcaggttagttactcatgctgctatactgtttccaaactcttaggattctagcacattgttttagtttaattttcactgttcctttaaatgtttatttaattcattttctaaaatcacagatatgagcagagccttggagaccatctagtagaatccttccgtggaatagatattaaaataaaaactcatattggttaagttactttacaaaggacatatagctggttattgaaaaaagtggagtaaaaatgaaaatctcccaaatccctaggacagtgatttctcttacgctgtgctatatcactaaaagattttatagtttccctttggccatcagagaagctatgtttaatgtcaagcctgattcatagttaacatcatatcttttgggagcctagatatgataaaagcaaaagagctacaggcattttgaagaagcacttcctacacactactatataccttgaatttgtactggaattgtttgataccctctcagtttattgatactccaaaagaccgaatttctaggtttgttttctaagctttgtcaataagggtagtatttagtcatgcaacactttagctcaaaatattatcattacacattgtctatatgtaaaaataactttgcatatgcatatagattttccagttccattcagcatgaggcatcaactctttgtagtcttttttatataaacacacaaaaattagtttatgacttgtgctatcatgtgttcatgctggaagacggtcagatgtatgtagaatatagcttctgttagtgctcatagtctggtggttcacaggaaaatgaagaataacacaaggaagtgcatgtaattattttaataacttcattcttgcaaataacagaatgaatgaaacaatgttttgcacaacctattttatttgattttcaaaggaagtcatcatgcaatagtccattgactttaattctacctgcttactgtcataaagtaatcttcatggcttgaacaatccagagcctgtgaaatctcccttgaatctctgcatctctccatttccaacaccatcagcctactcgaagtgacaatcttctgaacaattgaaactgcattcactcttgcctggtttgtttactcatcattcaggcctattttttaatgtgtaaaattttaaattttttgtttaaaaatgcaagtatgatcaagctgctctctgacttaaaaccatttggtaacttcctgttggtcttaataacttcccattgctcccaaatccttaatgagaccaacatattttgcttacttttttctctttctcctcctatcttcaccccattcctctcatcttactctctcagcttctctcaccatgaaagtgcatgccttgactttttcatcccagggcctttgcacatgctgcttactccatttgcaaagtattgtctgtcaaatgacttgcaccacttcagccaattatctccttttcatgcgtgaatttccagattcaatgtcacttccttaggaaagctttttcttcaaagactgggttagaattccctgtcacataccttctaacacctaacaccgtgcagtcctgcttcacagcaataatcatagatataatgtggaatttattgattttgttgaatttattgttaaattttatgctaaataaggccgtatgttctttgttcacttcctccatgagaaccttgcatcttgttttgaacacggtgaattctcagtaagtatttcctatcatttcaaattttttgtgcctattttattttttacataatatattggtagaatattacaggtatataatttatatagtgataaatgtagagagagaatatgtactcccttcccattccgcttccccttccccttcccttcccttcttcctttccttccctccctcctttcctcacttcctcctttccttcttatttttttctgtaacctaataatattgtataatcaaaaagtctggagacttctgcttgttttttacttaatacgtattttccttctatttaataaaaggagactggcctgtcttttaaattgcattttatggcctaaatttctactatatgattcaaaaattgctctgccatagtttgtgagaagacactatgttattttacttcctaaagaaagggtagtgaacaaaataataaaagctttatattaaagacaataaagttgatagtgttgtgaaatcatgttactcttattttcggtctgttttctttccagatctctttcctgatctatggtatatatgccagaagccataaatacttaatacagggtgaataaaagacattttaaattaagcatgcccccccaccaacattatcaagagtaaaatgaaatagaccaataaatcggcttacttactggccaacacctaaattgattattagatgtaatggtacaaatttgtataaatatcacacttccctctaatctttttaaatgaaatatgcaggaaggattgtcaaatggaagtactatactaaaaagcgattatcaccatggtaatgttggcttgcttttctgttccttttaatttggttaccctctttattgttaaattttttaaaaagttttctacttttacattttttatttatacttaacacataataatttaaatattggggtacaatatgatgtttcagtgcatgtatacatagtatgaggataaaatcagggtaattatatacaccaatttagacatttatcatttctttttggtgacagcattcaaaatcttcacttctatctgtcttgaaatatatattacattgttatttgctatagtcaccctagtgtgtaatagaatagcaaaacttattctttcctgtctaactaattttgtaccaattgactaataacctttcccaagaaccccctcccacataccctcaccaatgtttgctaactactattctactctctacttatataaaatcaacttttttaggttccacataggagtgagatcatgcagtgtttttctttctgaacctggcttatttcatttaacataatatcctccaggttcatccatgttgttgaaataacaagatttcattctgttttatggctgaatagtattcaattgtatatatatatatatacacacacaattgtatatatatattcatatatacaattgtatatttatattcatatatatacatctattgtatatgtattgtatatgtattgtatatatattgtatatatattcatatgtacaattgtatatatatattcatatgtacaattgtatatatatattcatatgtacaattgtatatatatattcatatgtacaattgtatatatatattcatatgtacaattgtatatatatattcatatgtacaattgtatatgtatattcatatgtacaattgtatatgtatattcatatgtacaattgtatatatatattcatatgtacaattgtatatatattcatatgtacaattgtatatatatattcatatgtacaattgtatatatattcatatgtacaattgtatatatattttcatatatatgaatatatatgataaatgtgatatattaataaatgtgatatatatcacattttcttcatttgtaaatgggcatttatgttgattctatatcttggctactgtgaatagtgctgcaataaacatgggtgtgcatatgtctctttgacatactgatttcatttcctttggatatatatctagtaatgggattgctggatcatatggaagttctatttttatttttttgaggaaactccatactgttttccataatggctattctaatttacattcccaccaacaatatataaggtaaattctttaggcattgccttaacctatacagtcactgcctcactatagaagttattttactctgattttgtggcatcattgtgttttaaacaaaaagtgtcatctattatgataatattatggcagctgtatttattttcctgctttctgtaaattagggtctcaagacttccttaagtacaattatagccaaaatctcatatgaaaaaaatgacagaaacatgcatcagataaaaaaatataaaaatcttcagtgactccaaaaatatatggtcatttagttttaaaagcaatttcaaactacctggtaggatctaatttaatgattcttaccatgatttcttaaagagtattcatcgttgcctccccttaacttttaatgaaaataactaccaaatctctttgttatttggaaactaaataaataaactggatcattaacctgaaaatgttatcagtggtcccaaagtttcactaatggaattttacatatttaaattaagcaataaaggataagaaaatatgtaataaaataattagatttaatatctatatgtggttcatggaaaaatcaaatgttactttgaaactttgtccctataataatatttaattataaaatacacaatagaaattactcttgagaataatttttatgtacctgattgcatttcaatccacatttcccatggaacctgaagcaaataccttacaaaaaagtaaaaattctataaggaatgtactaaatttgtaccccagcattagtgatagaatagatgtctacacagattacaaataagtcaacaagttatttgataatgccaattcttagatgaaactaaaaccttttacattatctatattgttcccttttatatcaacaatgatctttttcctttacctagtcaagttgctagagaattcccctttcaattcatgtagaaatcactttctttataaatctgtgcccatctgaaaacagccaatacttcttggatttttctttattcattcttcacatgactttctttatctgaaggaaaaatagtagatataacctatgaatcttattattcatcaaaaagacagagaatgaacatgtctttagggattactatgaaaatttgacaaaaactatatatgaagatgaaggcgagtatttgagatgacttgcaacctgtttttctgtttctctttcttagtttagaaattcaatataactatgatttcagataatacaaaccttgtcagttttgttttatgaataggttggatgtctcctttactagaaaaatgggaaatatgtttagtgaatattcaacgtatatgtagaagtgattagtatattatttattgcaatttgagaaaccaaattgaaaagtcaccataaattatgaagaaaaatgcataacattccaacccctcgataaaatttctttgaagttaatatgaccatataataacttttggtgttagaaatatatattttatttttacttgaactccgataacttcagcaaaatgctgttaaaagtattctgtgcctccctccattattgtattagatgttttaagaacataacaatgtggtgattattaagagtgaataattatatttaatgaactatgaccatgatttgaattttatatggatggtggtttactttctgttactgaatgttgcacccagtgttgtgggattttgttttgttttgtttttgagatggagtctcactctgtcgcccaagctggagtacagtggcacgatctcggctcactgcaacctccacctcccaggttcaagcaattctcctgcctcagcctcccgagtagctgggattacagatgcccaccaccatgcccggctaatttttgtatctttagtagagacagggtttcaccatattggtcaggctggccttgaactcctgacctcaggtgattcagcctcccaaagtgctgggattacaggcgtgagccactgtgcccggtcataccaattgtttttaagtcatagggtaaaattgaaagggcacagacaccagaattaaaatgcaggtctgtgtgaatgacctgaactactctggtcctcaatttttttcacccataaaatcggtgttagatttcctactttcccaggaagtggtgaggatggtgttgtcattattgaataaattcaaacatgagtcatgtaccacagcatctaactaatataaaacgcttagttgatattaattctattgtctctatgtgagtatgattaaatgtaaaaaagtaacactttataaggcaaaagatatttctcaaaacaggctgaagataaagattatagctatagaattatcaagaattatgaaatatataaatagaagtaaagttagttaacatttgggagatacagtgttcaatcagtaatttattaggcatgcaaaattaaggctgtagacatagaaaaataattatctgagagcaaaactaaatatcatgtctatgtttctaaatgtcagtacaaatagcaaatggagggaaagaaaaaaaaaagggacattttgctttcagcataacactccatgcatttgaatgtttattgtggttttttaatgggtaaaatagggcttcttaactgagagaatgaatttgtgttcaaatagtggttttcaatttgttctaagcttcttaccaaattgaaaataatgacccattttgccaataataacctcaagatgtctttaataacccaaggtattttgaaccattaaactggcttgaccaaattctgcttagtagcacacatgcagtttctttcagcatcaagaaaattactacatttttcttttcaaaaggttaagttagctgtgaactgaagtttttctaatttaaaggttttttaatactctataggtatagctaaatctcagtaattgaatttgttcgtgaaagcaattgtatgatcctagaatacatatgtggttttcagttcattgcttatggcattggttctcaacgtgtggttccttgaacactagtagcatcacccaggaacctagagatgcaaatttctggtccctgttcaagacatagtgaatcagaaactcaggagttggagcccagcaacctatttttttaaatcaattttattgtatatatttgaggcttacaacgtaatgttttgggttacatatagacagttactctagtgaagcaaattaggaaagctattgtcttggtgtagcttgtttatatgtgacaagaaccacaaaaatctacttacttaacaaaaattgctaatacaatacaattaacatgccctccaggtgattctaatgcattctgaaaatctatcaagtccatatctggcatttaataccatacattagtgtttgcagcagggaagcaaaagttttgaggagagagccctcatcagataggtctaatgaagtttaatgagtcttgtgtgattaaacattgacaagccggaagactttggggaatcataataagaatcattcgagtcatgagagtctcattggataactttcttcagcaattcattaaacattggagaatcaggatgggaagaggaggcactgaaagaaaaactggtgaatttggcatgggatcatttatctgaccacaagctgagcagggagactgttgtcttttcatggatgtcatgtctcttacagaacagagaggtcttggacttgctgctaaacccacccaaggcaaccaaattatggttgtttttattccagtaaagtggtggttctcagatcccagtgtacttgataatcccctgcgtaattattttgaatacgtatgcctgagtcacttcctgagagattgtgatttaggaggtccaaggaacatacttacaaaacagtgctaatggattgtaggtaggcggatgattttattcagatgccttgtacaaaatcagtattatttttggattgaaaaacagctaataaaaaaataaacacttaaataaagtattatcaagaaagctgttttaggaatctccacatatgggaaatactttttggtgcaatttctagtatcactgatttaataaactaaaaataatatcagataattgtttatattgttaatgacaatgaatagatagctactctatggtttactagtgttctgcattatgaaaggaacagaaaattcatacctttgtggtccagcagctactctaagtaaagtctcattttgactgttctgtaagtactttccttatcattgctaatggtgattacagggccactctattattgtaagttagctcaagcaacctggaagctgaggctacttcaatgatcatttacaagttataagaggaaattggttgtgaagagatatcccgcaaattcagaattagcatggcatatgctacttccatagagtaagaggaaacctaaaaggtaaaatgtagaagacgcagatagggaaaagcaaaaataaagcataaaagaatatgaaactgtctggatgatatgtgtgaaactttgccaaaagatgactcaaaaatcttcaatataagccgcataatgcttccatatatgtattaaaaggtcaacataagcatatggatttataaaaatgaacaatcaacaagatgcttttttttttttgagacggagtttcactcttgttgcccaggctagagtgcaatggaacgatctcggctcactacaccctccacctcctgggttcaagggattctcctgcctcagcctcccgagtagctgggattacaggcatgagccagccaccatgccctgcgaattttgtatttctggtagagacggggtttctccatgttggtcaggctggtctcgaactcccaacctcaggtgatcagcctgcctcagcctcccaaagtgctgggattacaggtgtgagccaccacgcccgccacagtcaacaagtttaaagtagttgacagtgtattgatatgagatgatttgcatggaagtaggaagatgaatgtgcagaaaaattgctgattttcaagagacataatttcagacaaagatttactaaattgttctggcttggctgatggtaacccatcacttgtgccgtgactcggagccataaaggaaaatatatcaaatagaaaaatgaaatatattaaggtgttattgcaaaatgcatgtgatgtttaggttacattgtcttgcttatgaagacacagctaagtaatagtacatatcaaatgtaaacttcatggagagatgaccagtggttaatagttttatgtaatatttgttatcgcataaaacacagaaaattcagaagtagatttatagtaaaaaccaatggggtttaatgatataggaattgctattccagtaaagtacagaaaaaaaactctcattaaaaagcataaaggttgatttatttaaattgcggtgggtttgtttactaacttcagtggataaagttctatagtaagaaaaaggaggcacaaaaagatccaggagacctggcgtgctggctcacgcctgcaatcccagcaactttgggaggccaaggtgggtggatcacgaggtcaggggatcgacaccatactggctaacacagtgaaaccccgtctctactaaaaatacaaaaaattagccgggcgtggtggcgggcacctgtagtcccagctacttgggaggctgaggcaggggaatggcgtgaacccgggaggcggagcttgcagtgagctgagattgcggcactgcactccagcctgggcaacagtgtgagactccgtctcaaaaaaaaaaaaaaaaaaaaagagaaaaatagaaaaaaagaaaggatccaggagtcttaactttgtataccaagtaaaaacctcacgctcaaaatggatattggttgtcataatgtgtttaaaatactctagcataatctttaaagaaaaatgatggtcatccttttgttatagtgacaagtcactacttatttatgttttgaattgagatttgtttatttttttccactgccttattgcaaagcacttgtcacataaaatatatgctcaagggccttggaaagccaatgaagtgagttatacatgggctgagattaatcagtttattatttcttaagcttagtagctataagtaaaagtaaaatgcaattcagtatttgaaaatgccacatactgccctctggagttttccatgcagaagaagaaatagaaaaatgagaattgcgaggatttagaaacgacatggagtagcttttaaaaataagattccaagctgggtgtggtggctcacacttgtaatctcagcactttgggaggccgaggcgggaggatcatgaggtcaggaatttgagaccagcctggccaacatgacaaaaccccttctctaccaaaaatataaaaaattagccgagtgtggtggcactcacctgtaatcccagctactcgtgaggctgaggcaggagaattgcttgaacccaggaggtagaggttgcattgagccaagatcatgccactgcactccagcctgggcaacagagtgagactctgtctcaaaaaaaaaaaaaaaaaaaaaaaaagattccagtgtatattccatgtagaaatgggaaaatttacatttttcttgaaatagtatactgcccaatatgatgcttttatttactctagcttagtagtgctaaaactttagcctgcatcagaattagctagggagctggttatacacaacttgttaggcctcagccctggagtttctgataccgtaggtctggggtagagtttggtaatttgcttttttttttttttttttttctttttgatacggagtcttgctctgccgcccaggctgaagtgcagtggtgcgatctcggctcactacaagctccacctcccgggttcacgccattctcctgcctcagccgcctgagtagctgggaccacaggcgcccaccaccacgcctggctaatttttttttttttttgtatttttttagtagagacggggtttcaccgtgttagccaggatggtctcaatctcctgacctcatgatccatccacccatgtaggcctcccaaagtgggtacttcgcttttttgacaggtttctaggtgatgttgatgctgctggtctaggaaccacactttgagaacccttgtccgagtttctcataagcaaatttgaaacaaacaaaaaaagcaacttcaaaggaattcctcaactgttttataaatgcacttactatggatggttacctttagaaaatttacaaggaaaaatcttgaaattttatggggattgttgaaagaggaacatttgtttcattcgatttttttcctctctagcaacttaagggatccatacttacgtctgatggtcatttctggacttacaaagacaatacgatacaattctgtttgtggtgaatagactttctgtatgatgaatgggtattagtttgaaaatgtgtcccctttctgctgtattgtgcccccttccccactaaaatcctcaatgccatttaccaatcttttcctgaagatttcttgttattgacaagcagagggagattggaccgtgattcaaatgaggttgacaaaaaccagaaagcatttgatttcaagactctaaatttacccaacgttttgttctggggatttggatattttggttataatggtcgtgatacttcctgactcatcagtcttctcagcattctcatttcccttacaactcaattgaaggctggccccagaggaactggggatctgtcaagtagtgttcatctcccttctcctataaagggagatgactgtatagtcaactgagctgaattctgcttcagtggagaagaaacaaataagggagaagcagttctgcccattagaggacataccataatacattgttgatgatggagcaggggggatgcctttctttttctctgagaaagaacagaccagttttgctttaatcacttgttttattggctcattttgaagatgtattgaatcatctgatcattacattcacaattatactcttaatgaactattttttctcactgtagttacactgaacttctcccaaaaattcgattgctgtctccagctgaatagacctattttattttatgaaaaattggcacaaaatgcttctgttcttttctagggcagagtggttaatttcatttgaaatatacttggttttcttataagaatcactgtgtatacatataagtacatttgcataaaatacaacatttacaataaaagtattgtttaaggtactgtattgtttaaattaattttctattattatactttaagttctagggtacatgtgcacaacgtgcaggtttgttacataggtatacatgtgccatgttggtttgctgcacccatcaactcatcacttacattaggtatttctcctaatgctatccctcccccagcccccgaccccatgacaggcccggtgtgtgatgttcccctccctgtatccaagtgttctcattgttcagttcccacttatgagtgagaatatgtcgtgtttggttttctgtccttgtgatagtttgctcagaatgatggtttccagcttcatctatgtccctgcaaaggacatgaattcatccttttttatggctgcatagtattccatggtgtatatgtgccacattttcttaatccagtctatcattgatggacatttgagttggttccaagtctttgctattgtgaatagtgttgtaataaacgtacgtgtgcatgtgtctttatagtagcatgatttataatcctttgggtatatactcagtaatgggatggctgggtcaaatggtatttctagttctagatccctgaggaatcgccacactgtctttcacaatggttgaactaatttacacacccaccaacagtgtaaaagcattcctttttctccacatcctctccagcatctgttgttttctgacttttgaatgatcaccattctaactggtgtgaaatggtatctcattgtggttttgatttgcatttctgtgatgaccagtgatgatgagcattttgtcatgtgtctattggctgcataaatgtcttcttttgagaagtgtctgttcatatccttcgcccacttttggatggggttgtttgatttttttcttgaaaatttgttcaagttctttatagattctagatattagccctttgtcagataggtagattacaaaagttttctcccattctgtatgttgcctgttcactctgatggtagtttgttttgctgtgcagaagctctttagtttaattagatcccatttgtcaattttgccttttgttgccattgcttttggtgtttcagtcatgaagtccttgcccatgcctatgtcctgaatggtattgcctaggttttcttctagggtttttatggttttaggtctaacatttatgtctttaatccatcttgaattaatttttgtaaaaggtgtaaggaagggatccagtttcagctttctacatatggctagccagttttcccagcaccatttattaaatagggaatcctttccccattgcttgtttttgtcaggtttgtcaaagatcagatggttgtagatgtgtggaattatttctgagggctctgttctgttccattggtctatatctctgttttgataccagtaccatcctgttttggttactgtagccttgtagtatagtttgaagtcaggtagtgtgatgcctccagctttgttcttttggcttaggattgtcttggcaatgctggctcttttttggttccatatgaactttaaagtagttttttccaattctgtgaaggaagtcattggtagcttgatgggaatggcattgaatctataaattaccttgggcagtatggccattttcacgatattgattcttcctacccatgagcatggaatgttcttccatttgtttgtgtccccttttatttcattgagcagtggtttgtagttctccttgaagaggtccttcacatcccttgtaagttggattcctaggtattttattctctttgtagcaattgtgaatgggagttcactcatgatttggcaataaaaaatccttctcaaccagttcaagttttatatttgtgtattctaggatagctagtgtggtagttagaataatgactccccagagatgttcatgtgtttatagctggagctatgttacctagtatggcaaaaaaagaaaagactgtagatgtgattaaattaaatgttaggggatgggatatgatcctggattatctgggtgggcctggtgcagtcacaatggttcttataaagtctgactcagaaaaggaactctaagtaaagctttggtaatcaacattattactgaacgcatgctgagtttgaataggctctgctgtgacttttaatttttttgtacaaccccaaaacataagtgatattctcttattggttttgagtattgagtccttataagagtacatgaaaggacagttcctacctcactgctgactagaacagtggttctcaaattttagtttgcactggaattacctggagggcttgctaaaagacaaaagtatccgattcagaaagttgggtggggcacagaaatttgcatttctaagttttccaggtgtgggtttgtgaatgagtggaatgggtaatctactcgtgagcactactggcccagaagaaggtttcataatctttgaaggaaatgaaaaaaaaatctactttaggcttattgatcaaattaacaacaaatcaatctctctctctctctcaagatttcactaatccttgtatttcaggccctttgttgatcatctcattgaataagccatgttacattggatagcatcacatataaggatggttgtcagtgcaatgagaactactgtcaaaaaaaaaaattgaggaacaatgttttatataaagcacctctgaaaacctgcagatataacgaatatttattattaaatatttttaatcctttttcatccttttgagattagtaagactcaagtacttctctattttcaagaagaaactcattattattattattattattttttgagatggagttttgctgtcgttgcccaggctggagtgcaatggtgctgtcttggctaactgcaacctccacctcccgggttcaagcaattctcctgcctcaacctcccaagtagctgggattacaggcacccaccaccacacctggctgatttttgtatttttagtagagacggggtttcaccgtgttggccaggctggtctcaaactcctgacctcaggtgatctgcccaccttggcctcccgaaatggtgggattacagatgtgagccaccacatctggccagaaactcaattatttttgttttttgaaaaaatagtggaacctccattaggctattcccttaattccaaatcttgtgctctatcagttgatcctcatgacctaatccaaacataattcctttttcatactttgctacattgctaagaatgtaaacattacagtgacgttttagattcctgtatctttatctgtatgtacatgtgtgtgcaatacatgctcaagtatgtctgtgtatatatcaaattgtttctgtgaaacaaagaaacggaggggtggtgagagttgaattgattcttggaaaatgcatccatgcttttgtgtttccttcttttgataaatataattactttaaaataaaaccttctatattgtctttccactgtgtgaactatttaaaattcccaaagaaagagtttaaggaacatgtgatctgactgagttgctaacatgtgacctggaggagtttacctggcctcttttagtctcaattttctcatctgtagtgaaaacaataatagtctcatcctaggtttctgatgaggattatataatatagtacttggaaggtttttagcacaccatgtgttcattaataattacttattagtattctcagctatttaatactatattctcactactcctatttgcaaaatagcactgttaggtctccatggagctctgaataaatcttttgaccataagaacattatgattcagcatctaaacctataattttttacatgctaatagtctaggtattactgtttgaaatacattatgttaagcatctgacctcttccttgtactttgaataccttgatcatttcagctaaagttcactgatggggcaaactttagaaagaattaggtagaagcattcactgactaattcagtcaaggaacaattctagaattcctactatgtaccacatactcttttttagagatacagcagtgaaccaaacataccaaaaattatgcccctgtggtatttatattctagtggagtgattgctctcaaaattgcataaaataaaggatggcaattatatttatataactgctaattcaactttatccatgtttcagattttcaagaaatgctcctttttaaattatcataataaagcagatgcaactgaagaccatttacgttcatttttacaattcatctagactcataagcactaataataaataatctctaagtcattgaaatattgtcatttatagtaagtatgtatttggtctttttctccatttcttggcaaacaactgctaaagcccatggaatctccaaaatagtgtctttgtgtgtaataatgagatgactgatggctctggcctcttagatagctttaagatggagggcggttgccaggggaaccaaccatgttattagagagttggaacttttagccttgcccccccccaccccatgccttccctgacctctggtagaggagaagggctgaaggttgacttgatcactgatagccagtgatttaatcaatcatgcctatgtaatgaagccttcataaaaccccacaattcttatggaaacagaaaaactgaatctggcactctgctttactagactaactcctgggcttttccattctgtagcatccaaaggaaaaaataagttttgtgttggttgatttgcagacaggtgtgtagcactaatgactgcattccagaagtggcagagctaaggtgatttgattttctaaaatggtaaaaaagcctttgtaaaattgcaaagaaaacaaaccaaaatcttcctttggattgcacatagttgaattgctagagaaatcaattacattaaactttgaaaaaagattttacatgtttatattacgtggagttaaattacacgctcatgtacttagttttttttttttttcacctttgtcaatgtctaaagaggcatcccaaagtcacaaaaattgtgaaacattgttttgtcatttggtaacggccagcatatgacaaaacttgtaacatatgtgccctgtggtaggcacaataatggccttcccaaagacattcatatcctgatttttggaacctgtgaatatgttagcatacatggcaaaaggaactttgcagatatgattaaataaagatcttgagatggggagattgccctagattatccaggtggactcagtgtattcacagggtctttataagagggaggcaggagagttagagtcagagaggatgagatagaagcagaatttgaagtgatgcgggaccatgagacaaggaatataggcagcctttagaagctgaaaaaggcaaacagaagggattcttccttagagcctccagaaggaaagcattcctgcttacccattttagacttctcacttccagaaatataataaatttttgtagttttaaggcactaagttttggttacttgtttacagcagcaataggagattaattcatgtcccaagtacttaaggccagtattgtcttccaatgaatgtgacgtcaaaaaaagaaaccaaatatttctatactgtttcctgtggagatgtactactctgattttttccctcttctccatccctgcagatgctgactgagttcgctctgatcatctcccatctgaatcaatatagctttctagaattttcccattcttcaaacttgcatccctccaatccagccccccaccatttgattgttcaaacattttttgtcaaacctaaatcctgttatttctctgcctaagcatccttatggtctcctatgtttctgtggaataaagtgcaagcaggtgactttgactgacaaacccctccatgatctacatcttgattgccttttcagtcatctccctcatcacatactcatctctataccctgtggtacaaactgtcatccccagtacagatgagattattttcttgcctctggctctttgttcaaacttttcctactgaatgagatgccctcctctctcctcttcactcccattccctattttattttattttatttacttattttgaaacagaattttgctcatgttgcccaggccagagtgcaatggcacgatctcagctcactgcaacttctgcctcccgggttcaagcgattctcctgcctcagcctcccaagtagctgggattacaggcatgtgccaccaggcccagctgatttttgtatttttagtagaaatgggttttcaccatgttggtcaggccggtctcgaactcctgacctcagatgatctgcccttctcggccttccaaattggtgggattacaggagtgggccaccgtgtccagcccccctttttttaaaaacaaaacaaaactttttcttgtttttaggacgtttgctcaaagaagctttgtgttattcctctagttagaactgaccatgttcttctttaggaacccatttcaacgtgtatatacttctattataaaatatacacatatttctattataaaatatacaccgtcatcctgacttgtttgcgtttccatttctcatttctagcccatgagtgcctaggtggcaggaatgatgttttattagtctctgtgttcccagcaacgaatatagtatttcagagagtagtagggtgcctaataaaggcttgatgagtgaattaaattaaccagtgctcacctgaggacatatgacatttgatgaaaattatacattgatttcagctgtaagaaatgatatttaaattattatccagccaaggtttgttttcttcaacgcatcacttaacatgcccctgtagaatgccattgagccacttaaattatgtatttttgtatgtttgtttgttttcttttttgagacagagactatctctgtcgcccaggctggagcacagaggcttgatctgggctcactgcaacctctgcctcccggattcaagtgattctcctgcctcggactcctgagtagctgggcctacaggctcatgccaccacacatggctactttttgtatttttagtagagatggggtttcaccatgttggccaggctggtctcgaactcctgacctcaagtcatctgcctgcctcggcttcccaaagtgctaggattgcaagcatgagccaccgcacccacccacattatgtattcttcattgagactgtgttcctattcttttttccccggatttcttgatgagcattttgtgaaagcacaagtaaaataatgttctcaagtcaaaacaaattaaataaatcaattcctattagtacactggacttgtcatagaagacaattttgtgagtctatatgagatgtactgtgttgttcctaaagccatgatgatttctgttattccatagaagtctaataaagcattcacagagtaaattgtacagtgttaaaaacctgccatctttatcactttcagtaacaccttctaaatgatcgtgagtaatttgtgattttaaaaattatatttttaggtatcaaagcaataatgaaagctttttgtcaagtgaatcactaagtaaaagtttgcatttatcattcatgtaattacagaatattcaattgactggaaacattccttaacactttcttcttaaataagcatggtggtaaatttccaatgatgtctatattcttacgttttgttttttcacagaggatcttaatggcatgtattcctaacctgactttatattgctatatgactttggggaaattacttacccatgctaggcctctgcttctctaactctaaaatgagaataataatgttgataatttcaggaggttgttgtgaatatcaaatgaaaatgccagtaaagcacttaccgcaatgcctggctcaaagtaaacgcttgatcaagattagctataaatatcattactagttgtggatacctgtgctttatttgtttatgacataatgctcttcatttaggaggcactctatgagtgctgttgactccatgatactccaagtcataaaacataattaaactacaaacctggatgtcaaggtgatttacaatgtaacagagatatgataaatctacaactaattataaggaagtatatgattaattgcttgagaaggtcaaatgtgtaataggtttataaagaaagcagaaatgacatttttagctgggctcaggtatcatggtgtcacagcagcaaaaaaaaaaggctccatttaagcatttaagaatgggtctaattttgacaaaggaaataaagaggtattctaggcaaggggcagcaaatgactaagaagaaggaggagagtggaaatacttaaataaagcaaatagttttagttttacttcagtcaccctactattagtttgagaatttttattacctttatctctaaataaaactcactgttaataggtgtttacataacagcctgtaataagcttttaatatttgttttcatgttgatgtgtgaaggtttttttattcataaaaattatgacacatacaaaatatagtgttgctataaaaatgaatgatgatcataccaattttttaaacagctagatacatgcagcagagttgaaagcaaataacaaaaattctggtatgaaaaatgatgtaattggcctcataagtcttctttgtgaccaacttggacagttgctctggctgatacaattcgttttgctataatcaactattaggatgccagaaatgagtttgacaccttgagtacaatcctttagtccagttttgaaaaaggctaggaactctgcaatagtaaaaatattaaaaagtcagtttaggttgagaaacccttgatttaaaagacttttatttgcaacaatggcctagtagaaaggaaagaaagatagaatataagaaaaaggaggaggaaagacaagtatatttgtaatcttgttcccatagttgtggcattaagttaccacggttgcaggaaaaagaaaattcatctctaaactgatctaaggtaggactggagtgtcatatctttaatacatatttctgttattactaataattataatgataataataggtatttacttattgactagtatatgacagatattctatgtggtgtttgtgtacataatttataatgcaagagaaatttttaaaaaggtatgtacatttcataggtaaggaagtcaaggtttaatgaataagtgacaaaatcagcatttgaaattttttctgcagaaaagtaaataccacatattctcacttataagtgggagctgaattatgagaacacatgaacacatggaggggaacaccacacactcgagcctgttggagttgggggggagggagagcatcaggaagaatagctaatagatgttggtcttaatacctaggtgatgggatgatctgtgcagcaaaccaccatctacctatgtaacaaacctgcacatcctgcatatgtatccctgaacttaaaagttggaaatccaaaataaaaataaagaaacttgttctgtataacaacaaagtatttagccattcctctgttctagacttggtctagaagggtcttgcatgatgtttggcttataaattgaggagcaaatgaatattttatgaaaacatttactaatcctcagaatcttctgccaagaattatgacatgtgtaagacttgactctacttgaaagctaacaaggtagcttgccacaggttcatgaatactggcacaaaagacacagagtattgggacagaggcaaatggccttattactcatggcaataaaaactccccaaaccccaattctgagggtgtggcatgaaaaaggtcagatgacgcctgtttgtactgtgagttgcattataggataggaaccctgagtatagggaaggtaaatctttatactggacagtaagcatgcatgcccattgctctgaaaggagacactgtcttcatcttccaaggccgttcacaatgcaaacatcttttaaaacatcatctgcaccaaagtacctctacttgcaagacttaaaaaaatgtgagcaattcaagaagaattttctcctaacacctttcatttacacaaatgtattcttaggcacatggaaccaatctatcccgttttcaccccttactcccctatcctcatactcttctgctttaactgttatttagattccaccatgctgccataggagagactctagctgtaatacattcaaactgacattgaccagcctgaaactggaaggaaaccatatacttatttggcacaagggaacttggctaactctgaaaagctggtctaaactgccctctagagctctactctaccaattagtgccaaatctaaccaattacatgcagttcccatgcatattcctctctttgtaaatgaaaagtaagagctaagtaagcagtgggtcacccagcttctggctaaactagaatagcttgcttccccaggagcctgcaatacttacagcctcaaccatgtggttaaaatcattctccttccacagactactcctctgtgtctttacaatgaacttccatccctttaagcaatctctgcatgtctcttcctttgtgactctgagaaatttgactggcaggataggactatatttatcttcctaattttaaaagcatttaattaccaataattaccaccaatgtgattttttcccctagtgcacattaaaaattttgaatcccattttctgtaataatttaagttgatctggagggacagagagtaattaattatctataatttctcaaactgtaaatgccgaatttattgaagtgaaacaaatccagggtagaataaggctgaaataaataggattgcatgagaaagaaggatgcagcaaaattaaatattttttcaaaattgaaagagcttaaagctcttaagtactgtagttgggttaaaacatacactttttttttttttttttttgagatggagtcttgctctgttgcccagactagagtgcagtggcacaatctgggctcactgcaacctccgcctcctgggttcaagcgattctcctgcctcggcctcccaagtagctaggattgcaggtgcccgccaccatgcctggctaatttttttatttttagtagagatagggtttcactgtcttggccaggctggtctcgaactcctaacctcgtgatctaccagcttcggcctcaatgtgctgggattacaggtgtgagccaccacgcccgcccactattttaatcagtatgtcaggtcatgtctcctaaagccctttttaaacaaaaattgagtgtttattgcttgcaaaatgtttttactgtaatgagtttaatatacaactgtgagccataagaagggaacaattgagaattgtgttgtttttgttttttgtttttccactgtggttctttaataattggtatagtttagatagtacgtgttttttatttgccaaatatgtaaacgttcttatgagcttctttacagaacgtcttcagtgtgaataagaataaagcagaatataagatgtgtctgtgcattttgcaacgtattgccatttaaagggcatggattttggactcaatcacacttaagtgttataagctctgaatgtattaatgatatgattttggacaagatatttaacctctctgatactattttcattatctctaagctggtgataatatttatgttgcaaatctcttgtgagggcattatggaataaattataaagatatctaaatcagtgtctagaactctttaaatgttatcttcatttccccctctttttcctagtttttcttgttcccttatgttccctaattatcttaatatctaattcttcctgttatataagttctcagaagaattatatattcatataaagtaagtgttcacctgttttcagtaatttcattatctcccatttgagaaattagaattatttcattactgctggtaaatatgaaaagaacaagaagaagagggaaaatattatatattttcctacccaactttttcctaaagcttagcactaaaagctcaatttttatatatacgttcataaattacttgaatcattcaaaagttgtctgggataatgtgtgattcatattttatatctctactctggcactatcagatctgtatatcaggaaatgtactttgaaaactctagatctttataccacaaacacaaggcattactattgataataatataatccagttatgggccacacattgtatgaggcattagaagaagtatgacgtgaatggcatgttgggtcatggtttaagagataagtggtttagagcatggaccttgaagttaggcagatcttgtttcaatcctgactatcactcactgtttgaacttagacatatcatctaaactctccaagcctcagtttcctcatctctaagatgtgactaatacttactaccttacagtatcattgtaggatacgataatgtatgcaaagtgtgatgtatactgactagtacttaatgcaaatttaataaatggtaattattagtactattgctaataagacaagacatctgtccttatggactgtcagtgtagttgagaatagaggatcatacgctatttggtatcatatgaagccagatgtcctatttccaataatagaggttttttaaaaagtactaaatgggtataagaaagattaagtttcattggttgactctccaaatcgatttcagtagcaaccatattccttgcacggactatcaaactgtggtacctgctgcagagggattctactgatattaacttatgttggtgttaaggattagtcaaagttgttgtgaacatgacaaaatactaaaagcacttagcacagttgatgggatacaccagtaattttatagatgttgcccatttgtatattcttgtcaagaaccaattttgtaaggcagagcttacaaaagactgttccttgctgagaaggctgacagattcctggtaattgatgccgatgtgtgttgaaccataattatgaactataattagtactatcctccatagattagaatggtctttatggaaatccttttttcaattaagtactgtttatggcttatgccaatacattcagtattaagtcagaactcttccctgatgaaagcatgatgaatcttgcaatgacctttataaacttaataaaataacattaattttaaaatcttgtatccaactcaattatatactggtgtattgaggatctgttctctataactgaggtgaataatacgagaaaatcaaataatattgaccagttgacatgaaaaaatacttattttggaattggctgtattgatattatattctctgaaatgcgcatatatttcaccatgtctcaaataatagattgtatatagttaagaaacatttgtcattcaagcaaaaaatgagtttcatgtatttgcaatctaatatatataggtatatgtatatatttgtgtttgcactgatcaaacaaggttaaatgtggctttcttgcctatttatataactaattgtgatgtacattaattgaggtaatgatttaataattataaaaattaaataaataagcactacgtatataatgtaataaacagaaatcaaccttatcacttacttttcttttaagtgtattgggctattgttcctcatgttccatgaaacctagtccgcattttataaccctcggagtcactttcaggagaaaaaagaaaagccctcctctcagtgattaatgtggcctgtaataatcaaaactctgtacttattttaaagcagtggtttccttcttcatttccccccacctccccatcagtctggcccagcagcaagctaaaagcccagtcagaaaaggagatattatttgatttcttctttctttccctgccatgtactttgacaccttttgctgtatctttcaaaccaggttttggattccttatgattagagtgtggggagggaaaagaaataaagggggcagcagagtgttaacttaactggcattgtggtaatagtccacagggcgcttcagaggtagcaccgacctcccccatggagaaaccttctgcctgtggtttctttcactggataaaagtacctccatttcagcttactacagtctccgccctcatccccaggcatttagaagctcttttcacatccttctgctgaggcatgtggcccttacagagatttatcttggtcagggtctaagatgcgactaccccagctccttgtcgcacgtggcccacctctgttccattcatgctccaacaaaatttgagaccaactccaatgcaagagcaaactctcctttgctatggaactccccagctagccagtctactcagctatgtatcaggcagcagtctattctttcgttctccacaaaccgaagggtgaaggttttctcttgactcagagtgaaggggaaagtattccccacccctccaaaggggacacgactcgcaggcatatggacagttgactccaaaagctgtttcaacttcttacccctttatgcccttgtgtgtgggtagtcaagagccatggcagatagaaggtgtcttgttcttcaactgaaacttaaattttaaattgcattacataatttttcagtatttctctattatctttacaaaagaacatatacttactgaaaacaaggtatctggcatccctagtgtgcattttggtggccccaaaatttctttgcagtgaacacatttaatagatggagtgattatttaacagggaagcatttatttgaactcttaactgtttaatataaccaactagtttatttcttttacattgtaatgcactaaaagtaactataaactagaaaaccaaatctatatcattgaggaacaattctattctcaacattgaatgccattttaagattaatggttttggcttataataagaactaaatataattttaaaaagctattttcctatttatccatttatgatatcttccaaataaaatgtgattccactaaaattattgatgatattaccataaattcctaatataaaacagacaaaaaatatatgtagcaatctattttctttgactgttgtcataaaaactattggatatgtggcgtgtgtgaatatattatggttatgttcagaacttattatctaactttttctcatgaggaaaaatgattaggaagtatgttagtactaaccattaactagaacagttaatatgttaaatgttcataatattaacaatagcgttttaagcacataccttaaagaacagtttagatattagccaaagaatagtattattattattattggttgagtgttctatatttacattataggatttttattagatagcatgcttataaacattcttcatataaaatatagctaaaagttgagtgattgaagataactttattgttttttagtttataatttactttgctataataatctttcccatatgaatatcatattgattatcagattttccactttgaattttgtatttgttttttcaaattgtcagtgttgttaatattgacaagtagaaataggtaaattgaacaaccaagctacattagtatttcctactaattttttaaattgctagtgattaaattaaatgtcttatataacacaaattctcagaattcccatattaccatcttctaaaataaagttttctgttttttaatttataatattcatcaatagaaactgcatcagaaaatagcccatatattaactcttgcatttaagattttggcagaataaaagataaatagccttttaggaaaaaatgtaccctatttctcccccaatacatcgtagatctagggtaaaactactcttttatagaaaggcaaatcaattgaaatatagaattattctatagatatagtgtagtaaaagattagggcaggttggaggcgggtgtcatgataaaaatgtagaacaagggagtaattttatgatgatgaaatgaaacagcctatatcttggttgtcatagtggttccacaaaatgatacatataataaaattgtaaagaattaatacacacataggcaaataaattccaataaaaactggcaaaatctaaaatactatatgtagattgtaccaatgtcaatttcctagttttgatattgtactagggttacatgttacttatggagtaaactggataaagaggacaggagacttctctgtattatttttgcaacttcttgatctatatttatttcaagttaaacgttgaggaaagataacctcttgaatgttttagagtttcttccatttaaccaaagttgtgaattgtttttcctcaagagacctgtttttcacagtaaggttgcttaaaattagagaatggcctaggaaattaggtatatcattaatatcaaatatacttaagtaaattaaaagagcatttaaaaatcattggactgaaatactttgaatcaaattctgaaagagaaacattaccatatataaattaggcaaagattattatgattatttaacaaataaatttagccatgtaaatgctttgtttttttctcatgaacatcatttatattcatggcattgttagtaaaagctagtacctctgtttttatagattttcatttttttaaaacattaacacaaaaatgatttatacagtgtattaaaagatcagtcctctattgcactgttagcaagggctatctaaagcaaataggaccttgagatctaaatgtattgctgcattcatgtgtagatatctaatgtgtacccaccatgtgctagacactattacagaagctgtggtgtagcatttggggagaaaaagaaaacaaaccccttttcctcaaagacttttctttctgttctggggagatggaaaaacaaatacatgtgtttcaggtaaaaatatttaaaacgagatttggtctataaaaagttgtttaaaagacactggtatttaataaagacgaaggaattacttgggtatgaaatggtaattatatttattaatagagcccacaaatgtagtattagcatcatactcagcatttagagaattctcaggagtggagtcgatgcatatcttttttctcacatgccccacagttcctttaccagaggaaatgttccctatatataatttgaatgcattgtcattactttttttttttaacactgctccccttgaagtgggtcttccagtattggagatcaagttccacagtcacctcagtttataggtgagaaaacctatttgaagttaactcgccccaacccatttaatcagcaaatggcaaagatgaatttcagttctggtcctctgactccaagtccagaacactttcagggtaggaagaattatctcagaatatcttttcaaatagatctagcacaacactctcaacttcattttcccagagtcttatatattgatatgcttttcacagatatttactgagtactctgtatgtacatggtttctaggtgctgggggtgagaagagatatagtgaagaatgagacctaggttctgacgtcagtcctaaactgtgaagtagaaattctgtgtgtgcacaaatgattacagtattaatacaagggagaaagtggatcatgccatgagggaggcatagataaagtgctatggaagaccacagaaagatcaactgcttctatttccagacacccaggaaggtttcccaaaggaagtggcttttgttttaggctttgaattgggaggattgtggcaatggaactgaggctgtacttgggataagtacttttatctctccaatatagtaaattcaccaatatcgtccaaaagtttgttcatttatctaactaattactttttttttttttttttttggagacagagtctcactctgtcacccaggctggagtgcagtggcgccatctgggctcactgcaacctccgcctcccgggttcaagcgattctcctccctcagcctcccaagtagctgggattacagacatgcgctaccacgactggctaatttttgtatttttctgtagagacggggttttgccatgttggccaggctggtctcgagctcctgacctcaggtgatccacccgcctcggccttccaaagtgctgggattacaggcatgagccactgcacccggcctatctaacttcttaacctaaatccctgaaccttccaatttctgtagaaatttacactctgaagcagttaggtggattcctaaatttcctagatagtaatatgtctaaacaaattttcttcggtaatacttgacaatactaccccattatcaaaataacttgaagttagctgccaaaaagtccagatttatgccaggctgtcaccatgatgattttaaatttctgcattagtagatattaaacatttccaaaagtgcttaaatttccatccactaatttttttgtcataaaatagagattgcagatgtattttgtactttgaagaatattaagggctgaataaggtggaagcacttacaactaatgagcctgcacatcttgagtgagctacctagagaatgtttctccttagcaataaagaacgacaactgctttgttctagctcagtaataacaataatatcgtagtatgtcctttgggaaactaactgaaatataagttcagataagttcacatccttgtaaagcaatgatattttgctatgttgctttcctacttaaagctgccatggataatgcacaattaagtcaacacatctaggcttaccaaaaataaattcctagattgtatttggtcttatccatacaaatgcttttggtttatgggcctgacaatggaggagattggaggtcagaataatctcataacagttactggttgaaggcctcttgttaacccatcattattgctttgttcctatgacctggcatcagacttacccttctaatcagcagtgcagacctcccccaccacccctcctcccattttaactagaactctgcagggaacctcacacttgcttgactgagccataactcattgtttaggtctggccagttttttctcttgggggcagtaagttcctatatcttaactgccaactcctgtaaagggtaattctccatgatgctgcatggtattacactatactatataatataatactatactattatattaatataatgggaagcaataatattgcatcctgccttaccttctatctagtgtatattttcctaatcataggagctggcttttggatagcgatgccagtcctgctcaaacccaacttcatctttttcttttagatacgattttaggattcttagaggttagagccacatactttccttattctgtgtcccttcagtcttgttggccctttaggttacatctataaagcctaaatatatgcgttttaagttttaattattcactgtgagtttttgtttaactgaattatttaatttacttatatacaagttgaacaaaaaattaagtagaatctgaaagttatcattcttgctttctacttagaaatatagaaatcatttccaaagaaacaactgctttattgtaaccaaggcttgatttagaaaaaaacaatccatgatttttaaatgtctgatgtctgtttggagaattatctcaggctctctggggggaaaaaagaattagtgtatttgattcatactgcccatctctaaacccaattgacagccccactttaatgaaaatgcagcctgactttcctgagtgaatcactatctgattatacaaatggcccacaaatttctctgcattctctatgcctatacttccttcattcttggcagtaaattttagaaaggttgctgattttttatatacatcctatattatagggcatgtgagtgacattctaattttttaaagtaggcaatttagactgttatttaaattataagtttactgggtatcagcattatattttcttagttctttaaggaggtatttcagtgagaattttttttttttttttttgagatggagttttgctcatgttgcctaggctggagtgcagtggtgcaatctcgcctcaccgcaacctccgcctccctggttcaagcgattctcctgcctcagcctcccgagtagctgggaatacaggcatgcaccaccacaccaagctaatttttgtatttttagtagagacagggtttctctgtgttggttaggctggtcttgaactcctgacctcaggtgatccaccggtctcggcctcccaaagtgctgagattacaggcgtgagccaccgtgcccggcctcttctacccattttattttggccatcattgtacaatattttgatccttgagttggataaaaatagaagacatgcttttcaaatatatggattatgcaaattaaagtaacagaatagagatttatgaaccactctcaggctagaaggaagtgacaatttaataagagaacatttaataaggatacacacagaatcctgttcttggtcacagtagtgcactgcagaaataaagaacaaggaagatgccgctagatttggcaaaaaagattttaggttttttttttctttttttctttttctttttttgagatggagtcttactctgtcacccagactggaatgcagtggcatgatctcggctcactgcagtcaccgcctcccaggttcaagcaattctctgcctcaggctcccgagtagctgggattacaggtgtccgccacgacacccacctaatgtttgtatttttagtagacacggagtttcaccatgttggccaggctggtctcgaactcctgacctcatgatccacccacctctgcctcccaaagtgctgggattacagatgtaagccactgcgcccagccagattttagagttttcatgcattggtaagctcagcataagttgacagtttgatgtgactattaagcaggcaatggcaattgttggccactttaatataaatatattccctgggtcagtatttctcagagtggcttattgcatcaaaattacctggagaaattgtaaagtatagaatgcaagacccaacaagttatccactgaaacgaaatctcttggtgtgggatctgtatttttaaaaaaactttcaggcagtttttatgcaaattaaactttaataaccattaaaatggactaagggcaattttgatgctattctgttttatcctgttttatcactgcaggatagttgcgttttactctcttgcttatactttaagaagggtgtgaaattttggctgcattcgggaaaaaagcaactttacaaaaatggggaactaattcatgtccatgagtaatgcatggagaaaatggaacttttacatatttaggatataattgaacaattaaataaattatggtggttaatttgactgttattcatgaatatctgataaatatccactaccataaagagattgttgtgaatatcagatagtaacatgagaaaatgtttgtataaataacgttacacaaatattttgattacaagtgtctaaaaagaagatgcacattaaataacaccagaaaaaatacacccaaatgataagtggttttctttgaatgatactataatcacttttttttttgcaaaatagtctctgtttatgaatatgctcttatatacttaaattaattttcaaagttaataaaaactatgatattgttaattacctcaaataataaagtatactgtagatgagcagttcccagtctttttggcaccggggactggtttcatggaagacagtttttgcgcagattagggggcggtgcagctgatttcggggtgaaactgttccacctcagatcatcaggcattactaagattctcataaggagcacataacctagatccctcgcatgcgcagttcacaataggtttgctctcctatgagaatctaatgctgctgctgatgtgacaggaggcggagctcaggtggtaattcttgctagcctcctgctgtgcggcctggttactaacaggccacggactggccctggtctgcggccttggggttggggacctctgttctagatgataaaacattatttttttctaatacaggcaaatataaagaataatggtatgaaacgaatggaagtaaattctgactggatttaggaaaaaattttttctgggtctcaataggatgtgataaaattcacttatttaatcatatgtaccaagttctactttttaaattttgttgaagcaaatgcaatttatactttttttacaccatattcattaagtacctactgtttgttcaggatatacccatggctgttttgctatactgatggaagtttataaggctatgtattaaataaataatgttctggtttttaagttgtgtatttagaacataggcctgaaagcaaatgcttgtgtaaaaagaaaaaaaaaatccaacagtcaaaaagtcaggtctatgttataagaaatacagcattcctggaaaattgcagtgctttacattgcccagatgttatcatcgctgttgggttccttggcagagtcattcagaggctctgcatagctaatactatcatggttctctgtggcacagcccccccttgattgcatttagtatcttcttcctccagcttggggcttagcagtttctactcaaaaaagtgacacagcaataaaatttgaaaccatagaatgatcactcatcctagtgatgtgttatttggcatctttgaatatatgactattgcaaatagttcatttcaaattttagcagattgttttttctcaattcaaaatcacattgaaagggggagagaaaactgccacagtggaacgtttgcaggtactccattttttcccaataaaataatgttttatcataaattcagcatgtgttaagattgacatatttatagcatatctgggcaggatatagcaactagagctgtaatgattgctttctctactataaaaactatgacgctcatattaatacttaagacatatttatattattaagctcacattaatattaccataaaatatgacagtttacaggccatgtattactacacgggatttttcttttcttttttttcttaacttttattttaagttcaggggtatatgtacaggtttgttacatgggtaaacttgtgtcatgggggtgtgttgtacagattatttcattacccaggtattaagcccagtacccagtagttatttttcctgatcctctctctcctgccaccctccaccctctgataggctccagtgtgtgttgttcccctccatgtgttacatgggaatttttcattcactcttttactcacttcatgatttttggtatttgattaggagcaagaaaaacaaggaaaaatagatacagtgtctctttccatctgacattttccaatgcctagagtctataattctatctttcatcctattagatatcataatccagaatattatttaccaattttatgtcttattaactacaagtatatttagccaaatatttgcatagttatttcaagtacatttatatttattattttatatttttcattgcctattttgaaattatattttttaaatttctaaaataaaattaattttgataactgtaatttttacattggtaacttttgtgcattttgtcagtttttatagtcattgtaacacatttaaaaaaaaatatgacgttgtctctgttttttaactaaaggcaatttacattaccattaacaaggatttgtatatttttaagtcataatataaagagtcccttccagagagtcctccattccagtaacatacttaggaaataaataatgcatatgcaaaagacatagaaccattgtcaagatagcactttccgttttctttctttattgggcagacctatacacagttcaatttgcattaaactattttgactttagtataatcattattgatttttttttttttttgagatggagtttcactcttgttgcctgggctagagtgcaatggcacgctctcggctcgcggcaacctccgcctcgcaggttcaagcgattctcctgcctcagcctcccgagtagctgggattaacaggcatgcgccaccacgcctggctaatttttttgtatttttagtagagacgggatttctccatgttggtcaggctggttgcgaactcctgacctcaggtgatccaccagcctcggcctcccaaagtgctgggattacaggcgtgagccaccaagcccgacctattgatttctttttaatgaagtttctaggtttaaatatgattaagtttccctaccactgtaaaagaaaagttttgcatcagacacttgatacaattggcaagacatatgcaaactatgcaaccgacaaaggtctaatatccagcatctatagggaactaaaacaagtttacaagaattgaacaatcctataaaaaagtgggcaaaggacatgaacagaaacttttcaatagaagacagacatacagccaacaatcatgaaaaaaagctcaacatcactgatcattaggggaatgcaaatcaaaatcacaatgagataccatctcacatcagtcagaatggctattatcaaaaatttaaaaataacagattctggcaaggttatggaggaaagggaatgcttatccactgctactgggaatgtaaattacttaagccattctggaaagtagtttggctgtttctcaaagaactcaaagcagaattatcatttacctagcagtcccattactgagtatatacccagaggaatataaatcattctatcataaagaaacacacatgcgtatgttcaccacagcattattcataatagcaaagtcatggaatcaacctacatgcccatcaatggtagactggataaagaaactgtggtacatatacaccatggaatattatgctgccataaaaaagaatgaaatcatgtcctttccagcaacatggatggagctggaggccattatcctaagtgaactaacacaggaacagaaaaccaaatactatgtgttctgacctataagtgggaaccaaacattcagtacatgtggaaagaaagaaggggacaacggatgccaaggcctacttgaaggtggagggtgggagtaggatgaaggttgaaaaactaccttattgggtattgtgcctatctgggtggtgaaataatctgtacatcaaacccccatgacatgcaatttacctatataacaaacctgcacatccacccctgaagctagaataaaagataaaacaaaaaattgtcaagacagactactacaacaggggagaaagattttagtacagaactgagatctgtactaggtgagaggatttttaaatgctgaagtatagtaacagaaaagtaccgaatggcactggggaaggagggaaatttgtccaatgtgattggaccatctatatgtggtcattgccccatttcaaagttaggctactaccatctcacagagactggaagatagggcccctatctttatttgtttttattgatacacaatagttgtacacatatgtggggtacatgtgatattttgatacatgtttacaatgtgtaataaccaaatcagggcagttgggataaccatcacctcaaatgtttatcttttttttgtgttgtgaacacttcaattctttcaagctgttttgaaatatacaaaaaaattatttttggcagggcccagtgcctcatgcctgaggccaaggctggtggatcacctgatgttgggagttcgagaccagcctgaccaacatggagaaaccccgtctctactaaaaatacaaattagttgggcgtagtggcgcatgcctgtaataccagctactcaggaggctgaggcaggagaatcgcttgaacccgggaggcagaggttgcagtgagctgagatcgtaccattgcactccggcctgggcaacaagagcaaaactccgtctcaaaatatatatatatatatatatatatatatatatatatatagttaactatagtcagtccactgtactgtcaaacactggaatttattttttaactgtatttttgtacccattagtcaacttcatttcctccccctctctctaccaccctcccaagtctctggcagcaaacattctactctacctccatgagatccaaatttaagctcccacatatgagtaagaacatgtgaaattgtttgtcattttgcatcttcctgtttcatttaacataatgacctccaaatatccatgttgatgcaaatgacaatattttatgacttttatgactgaatagcattccattgtgtatatacaccacattttcttcacccattcacacatcatttagtcaactgcccgttgatagacacttaggtagattccatatcttggctattgggaatagtgctgcaagaaacaggagtgagaatatctcttcaatatactaatcgcctttcttttggatacattctcagcagtggaattgctggatcatatggtagttctatttttagtttttctgaataaatttcttacagttctccacagtggctgtactactttacattcccaccaacagtgtacaagagttcccctttccgcacatccttgccaccatccactgtttttgtctttttgatgatagccattttaactgggctgagatgacatctcatgtgcttttgatttgcatttccctgataattagtgatgctgagcattttttccatatacctgttggccatttgtatgtcttcttttaagaaatgtctattcatctattcaggtcttttgcttatttttaataggattatgtgttcctatacgctctttgtcaagtgatgttatgtattcatttaatactcaactataatgattaataatagttgtagtaattatatttttcctataagtaaaataaaattagacggatatattgtattcctatacataatcctgttatgagttccctatacattgtgcttattaatccctttgtcttttgcaaatatttactcccattttgcagcctttctcttcactttgttgattgtttccttcttgatgattacacttcaaagggatggttcctaggcccttgagaaattcattcttgggttgtagaagattcatctcaaacagtcagaggatttataattgcaaggttcctaaactaaatgctctaagaaacggaggtttgggttggaacaaagattaaaattttttggtagcattgaactttttcaggaagaaatttaagggaactggtgtcagcatcctagggacttggccctgagttgttagaaactatgctattatttgttcaagtctcttattatggggggtagacaaaattgtttgtactgaaaattgcagttcccatagaccaaggttgaggcctagccgaggagagagttcagaggagactgacaaaagttggtcaaggaaagagtctttttcactgacccttcaccttaggaaaattgcctgcaagtaatggcttatattagtgaatgtaaattttgtaaatattttacttttctatacttatagttgcaattcaaacattcgaattaaagaaacaagttgtgaatttaggccataatatttgattttatacattctgtgagattctcccaaaacgcatgccatcccagtgtaagcctggtcatatatatattgatgttatatagcatgttatcagctacattttgcataatcagtgtggtagattctggattcagagttcatgacctcaaaaattgactccacctcttatcaactgtataacattatcaaattgattaaactgtccaagcttcagtttcctcatctgcaaaatgggcattatagtaataggtattgcataaagtaactgtgaggattaaatgatccaagtgctttgcagaattcctggccagcagtaatgactcaatagatattagtttctttttattttattttattttttttattattattattttttttgagatggagtctcactctgtcgcccaggctggagtgcagtggtgtgacgtcggctcactgcaacctctgccacccgggttcaagcgattctcctgcctcagcctcctgagtagctgggactacaggagcatgccacaacacccagctaatttttttttttgtatttttagtagagacagagtttcaccatcttggccaggctggtcttgaattcctgacctcgtgatctacccacctcagcctcccaaaatgcatgctgggattataggcgtgagccactgcgcctggccgatattagtttctataatttgtattagatattattagtactgaataagtactagtggagaaagtaattacctgatctatatcattaacttatttgaaaactcttgaaaataagagatttcagtttttatttgaattttcttctgtcatttgctctgtatacttgctgttcttagcccattttcctttatttattttgtgtatgtataggataattaatttaaaatgtgtcatatttaaaagaaaataattttatcagttaaatgttaattctgttttttttcaagaacaaagacatcttttcttctgattcataactcgcctgagagggagtagacctttgagtatgtataacctatatatagtctggcttatttattaatagaggtttattttaaattataattgaacacagagtttaggaagacaattacatttgagattgctaatcttggggtcagagaaacttgattgcatacaattccaaactctttgtcaagtgatgttacgtattcatttaatactcaactataatgattaataatagttgtagtaattatacttttcctataagtaaaataaaattagacggatgtttacatggattatctcattgcatttttacataaattacataaaacacattttccccctgaaggaaacagtaatatatacatatgtatacaagtatttgtaccattttaataccaaatagatctagtttttaaaagatatatgtactgaaaagataaaaaaatgtaaaaattggaagggataattattgaaaaataaggtgaagatagtggtaagttaatacacaaaatacatgccatacagttctggaaactttgctgtagttggcctataagtgtttaacctaatagtcacatacattttattgatggatcagagactattttatttaaaacgctttcccaaattcagatgtcatgaattcacatgccttccagtcctcaccccaagggctagaaatgtgcttttatgaagtctttcttgcctttttttgtggagtgggggcaggggggaggattgaaagagggaatggtactgcacggctaaatttcaaaattttgttctgtaagtggaattttaatgtattcttcattttctaaaatccaagaaacaagagaggccataaactatttcctcaaataaacttagaaacacagagacagttttgaagtcatcaaagataaagtaaaataacataaatgattgaggttgaattatctgcgaaaagaacaaacatactttacattttgccatatcctgggtcatgaagtcaaaatgaaatagtcattcaagatctaaactctttgaaaactctgtcagccaaaatttcgaattttgaccatgtttgctaagcatattgccttctaactcaaaaagcagaaagagcaatgcttatttttaattttcttgcactatgtagtatttcattacatttggccagtgttgtgttgagaatgctcctgaacagttcaatggataactatatcaccttaatttctttcttacgagttttagtgtggtttctcaagagaaccattatacccatgctgacctagcatgggatatactagaggagtatgtgtgcttggttatctgagacagtattcttttatcatatttgcctgtatttcactgctttgacttcattatagatatcttatatagactgaaaaatcatggacttatgaaggcaacaattcataccaaaaataaagagtgaactactaaattatgttacaaatgaaggaagacgttaatatcaaagcaaaacttcctgtcaacacgtgagcagtataattctaataagcagttaaaatagcttaagaacgtaaaacttgggttttataaatacatatatatttgtaaatattgatctggatagttattttaagctgctttgaaatcacatttgttccctttggaaatatgcaagagagacaattacttgcctctcagtggactattaaggtttgcctttgcttatacctggtacaaaataactatatatctgatgtaagcaacagagatatgttatgcaagagtagatacggtatgagcagaatcatgcaaataagattcatattagaaatcttgtgtcccaactctggtttgtcagtggtgaaaacagagttaacaggtaatgcataggttcccaaattcctgatgaagtaacatctctctaaactacagatcaaacctccaacagactcagtcaacaaaagccataagtctaaaaacccaaaatgaatttggcaatgagaaatagagcagcgagaaacagtactgggcctaaagagccagaatccattgacttagaatcatttttagttggttggatttaaaagtcttaggtaggggccgggcacggtggctcacgcctgtaatcccagcactttgggaggccgaggtgggcggatcacgaggtcaggagatcgagaccatcctggctaacacggtgaaactccatctctactaaaactacaaaaaattagccgggcgtggtggtgggcgcctgtagtcccagctactctggaggctgagccaggagaatggcgtgaacccaggaggtggagattgcagtgatccgagatcccaccactgcactccagcctgggtgacagagcaagattccaaaaataataataataataataataataataaataaataaataaataaaagtcttagctaatctttcttcattagtacttctcagagtataggaagaatacattaaaaactccaagcaaggggtgggaggtctaagatggagagtaaagtgttggcagtagacatcacacagtatacagccaagcatttttggccaacttcctgctttaggataaagaaggcatcatttttcccatttgacaattgagaatgttgagacccagaaatgatagataacttacaaaggttatacagcaagaaagaaatgaaaatagtagtagagcctgattctcttaccttctatttagcactctttcccagatgccatgttgatagcactgcctaaaatgtgtctagtttcgtacttttgtcattgttttgatataaggtgcagtgggtcaagagaaccatgatattcaattcgtgacatttaatctatttttattttgtttctatgtgtgactgcatgtgtatgttcttttttctgcatactgcatttcatttccactctcctccccagtacaaacattgtgttttaagtataaatttttttatttgaatggtgtcctttcaaagtatgaattgctttctgtttgtgaattataatttatgtaaaatacattctgttagatatttcatttttcatcttgttttctcactaaggtttattatttgttaggatccttccacattgctatacacctactctatgacttctcacttcatggtgtgtatatattgaatctccatgaaaattgggaatagcgaattccaagctatttatttccttgccaggcagccccttggctaggtgcgcttatacaggcacaagctatgcatctgtacatatctgcaatgaagcccatggttgtgtatccagcaaattttgcctctttggccttgatggaaactcaggttacttctagctctcaccattaccaatagcactgtaatgaatagccttgtatatgtgtcttatgcacctgcgtgaaaattttcctgggataaatgccaattgtagaattgctatgtcaaagggtatgtatatacttaatttgactaagtagtaacagatggataggcagattgctgctgctgtctaccctaccaccagtagagcaccaaggctcctatgtcaccatatacatgtggttggttccttttgtatttcatatattcttgccttgtttctctagctgcagtgaaggaagggaccattttaaatggctcagattataaatcctaggaattattaaactaccagtgaatatacttggcaggtgaaagtcaaccaactttcaaagtggttcaaattaatcatgtgttttgtgaggtataactgttgtttaatttgtgtttttagagctaaacaatgttctcaatcagacccaacttagagttgttttgcttttatctctgatttgtttctttctttcacccaattaaatatgatttaattttacccattatttgctttttaaactaagacagaatgaaaatgtcaaaaataatatgacgcttctaaacctgtcaagtatgaatgtcatggatcacgaggatttactgttatattttgggaagttggcataatataaatcgtgacgctcttctgatagaatgtgtcatcactttaaacccagatgtctgaattttacagcaaaggactctgaataaggaaattcttcccattgatctgataatgttcaaatatatcttaaggaagggatagtcaaatgtgcatcatttaaatgtgatcttagatattttaatctattcatttaatttattctttactcatttgcttctctaataaaatgaatgacaataatctaacttcagccagcttcagaaatgtattcagtcatattatcatgaaatatgtaattctcatgagtgacactgcctggcccactcactgtgtcattgggattgccctttctctaagctcgcatgataaaatgtcattccaggtgcaacttaagagtcacgctccccttgtcctttacaataatgctaggtaaatagcaggaactcagtaaatatgcaccaactaactgataggtaacttttaaaatatgaaatcttctattctttgactctgtagagaaagtgtttttcttcagctctatatgaataccagatatttactgaatgttttgccacgtctcagtcttgcatttgcacgtccgcacactacttttatgccatctgttgtctttcgtcattcaactgcttatataggtgaagaataaaaacggagagtgacagattagctgtattctatcttctaacagtttattataacagtttagttagctttcatcccttcttaaacacacacacacagagtgagagagagagagggaaagagaaagggagagagagagagagagagagaaccgaaacaaagtattctctcactttcttctcttttaaatataattaattttagtaaccattgtgggatagaggtggggccggtctgagatgaaaacaaaaattgagcaaaacagccataaattgtttgtatagagtgagcatctcattcccaattatttgttcaatgctattgacataaagtttcctgtgttctaaagaattaatggcatcacatcctcttgactgtgctgttgcttacttggccatgggtgtcctgaagtaggtgaccataaaatgtattattgaaattggggcaggcttttagctttgttaataattctgttgacaacaggggtgaaacaagacatatgcttatcctgccctcaggaagcatcagaatgagtagcttttaaattcgctgccaccatgatgacttgaaggatcagaaagcctcttatacttgacgcagaaacattgtagaacacctgtaaagtggccaaggtagtggaaaaaacattcaattgggagtagttaaacctgtatgatactgaaccaaggagcaaaatgatgagtctaaggcaaggagaagtcagacgtagaattcctaatccgtacgagactgtacctcgtcaagcaaaacttgggagttttaaaatgaaattttggaagaaatgaattattacaatagcaataaccatttttgttaccatcctggttttcctgatctctacatattggcatgccctggattcagtccttggtgtcttggatcttccctttctatacttacagtcttatagtctcagaaaatcaccttatatatcaatgccctcaaatttacatctgtggctcaaagccttctactcatatccaaacttggatatacaacttgctactcaacatctctaacagtaagtcagtggacatcttcacatgtcctaacctgaactcctgtccccccgcaaagcctgtgactttcaatttttaattgataacaacttcatctgtgtttgctcaggctaaatggtttggtgttgccccgacttctctcctcatttcacatcccatccctaataaatcagctttaacactaaaatacagctgaccctcgaataacatggaggttcaggggtctggcagctccccacgaccatgcagttgaaaattcatgtaaaacttaggagtccccccaatttttttttcaaaatggagtctcaccctgtcacccaagctggagtgcagtggcacgatctcagctcactgcaacctctgcctcccaggttcaagcaattctcgtgcctcagcctcctgagtagccagaattacaggcgcccaccaccatgcccagctaatttttgtattttaagtagagacggggtttctgcatgttggcaaggctggtctcaaactcctgacctcaggtgatccacccacctcggcctcccaaagtgctgggattacaggcgtgagccaccacgcccagcctgagtcccccagaatttaactactaatagcctactcttgaccagaagccttactgataacataaacagtctattaacacatattttgtgtattatatgtatcgcatactgtattcttgcaataaagtatgttagagaaaaaaatgttaagaaaatcataaggaagtacaaatatatttactgttcattaactgaaagaggatcatgatataagtcttcattatcttcattgtcatcttcaagttgagtaggctgaggagaaggaacaggaggagttggccttactgtttcacagatggcagaggcagaagaaaattcatgtgtaaatggacccgtgcagttcaaacctgtgttgtccgagagtcaactgtatattcagaattagacaacttttttttttctttttttgacatggagttttgctgttgtcttccaggctggagtgcgatggcacaatctcggctcaccgcaacctctgcctcccaggttcaaatgattctcctgcctcagcctcccgagtagctgggattacaggcatccaccaccacgcctggctaattttgtatttttagtagagacggagtttctccatgttggtcaggctagtctcaaacttccgacctcaggtgatctgcccgcctcagcctcccaaagtgctgggattacaggcgtgagccaccgcgcctggccagaattagacaacttctaatctctattcccgatcttcatcactgttatgatctcttgtctcaattactgctagagtttctcaagtggtctgaaaatcagcactttctacccatgcctcaaactgcctagtctttgtatagtaaccggaatgttcctctttaagcaaagagcagaatgtgtaattgctctgtgcccactcttgcaattgcttccattgcattccaaagaaaagctagagtttttacaagagctagtaaggctttttataatgtggcctcctgtgtcctctctaaccttattcattattctcatctgcagtcaattcacttgagccacagatgcttcccacatacatgtctgtgcatgccttggggcatggacactgcttgttctttctcctttcttctggaggctgtccttccagatatgccagaattaactttttcatcttagtctttacttcgatatattcttctcaatgaggccaatttaaaattcaagcgtaacttcccccacctccagcacctacctatttcccctacaattttctttgatccataacatttatcatcctcaaatatactctgtacttgatttatttttaatgtttatattacgttcctccaacaggaatagaagctccataagggcagagatctttgtcaattttgctcatagataattcccaagtacctaggacagtatctactagatgcttataaatatttgcagaatgaatagataaagtaagaagcccagtgatgtcaagaaaatgaattaccctctgtgcacctcaagttgtgcaaactaaaaagattaaataaaatggtttctatatgtcaaccaagcgcacatgtgtacattttgtgtcttgtggggatcctgattcagaaatcaaatgcaaaaaaaaagaaaaaagagagtgagatactaagaggtatttgaccatggcttgttattccattattttaaaaaattattcttatgtcaatacatgtgataatcataagccctttggttaagggcttatgtgtttgggatgcaaaatgaagtatttagaaataaactgatatgaaattgaggatgtggttttaaatattccaggaaaaaaaataagtgaaaggaataaatcaaacaaaattggcaaatactgctaattgttgatgaggggtgataggtgcataggagtatattgtagtgttctcattacttttgtgcatgtttgaaatatcccataataaaagaattaaaattggtaacctctgaagtccctcactactcaaaaaatcttttattagagccatcattttataagtagatcatttgtatcagatattaagaggatcattgggatccccgagataattccacagtataacgaaaacataaaggaagataaagagagaaaatccaatagaatgtcatttataaactaaaccttcaactgtaaatgatagttgttctaaactgtggctctgtctaaagaattttacccaaatttccattcattgtgaataactaatgcaagtaaatgggtaaattatgtctgtatatttaatcattgtacaaattatatcccataattccattagcagaatggagtacaaacttttttctaaataagtccttactaaatagatttaacagcaataactatgcaatttgactaagcaacaaactgccatttaaactatatattactatataatataatatgtcattaaaatataaatactaaaggctgtcaagatttttttttaaaggattgggccaggtgcggtggctcatgcctgtaatcccagcacttcgggaggccgaggtgggtggatcacctgaggtcaggagtttgagaccagcctggccaacatggcgaaaccccgtctctactaaaaatacaaaaaaaattagctgggtgtggtggtgtaatcccagctacttgggaggctgaggcaggagaattgcttgaacctgggaggcggaggttgcagtgagccgagatggcaccgttgcattccagcctgggccacagagcaagactctgtctcaaaaaaaaaaaaaaagattgtttatcttctatgtgtatgcatattcatagattggtatagatataaattgtgtaatgtggatatacaagtaatgagacactgttacatgaataagttctgaatcgtgagtcattttgatgataaaacatagaggagaaacagatgagatcatggatataacttgtttgaaaatggtctcatcccataaagtatagagaggcagaacattataaataggacagttaggtgaagaaaaaaatatatatgggatttgacacaagggcaaaatattcttattaattgttgaaaatctaggaaaaataataatgaaaaactttaataattgagtaatttaaccatgatttcttgaggctatgtctttttttatgacaaaacatgctgatatagaggatcaaaattagatcatagaaatcatagagacagcaaacagcatttttgttttctttgctgtcattttgttatcttggcttcagacttttttatcattgttttgtttattacttatatgttataaactgtctcccctggcccccaatctcctgaaagttttagaagcttgatctggtccattctctgcttgaaccacagtaacaagtatctcctggcccctccttccatccgcaaagttggattaaatcctacattctcaattgaactcaaatgaaaatgatcacttcttccttaaacattaactctctcaacaaatagcttcagatttatggtcttaatgagcctttcaagcatgttttgttagtcaacgaaattggactttaggcttatttgtttctttgtttttttgttgttattgttgttgttgttttgttttttgttttttgtttttgttgagacagggtctcactctgtctcccaggctggagtgcagtggtgcgatcacaattcgctgtagcctcaacctaccaggctcaagtgatcctcccacctcagcctccttagtagctgggactacaggcacgtgccaccacgcctggctaatttttttaatttttgttttgtagacatggagttttgccatgttgcctaggctggtctcaaattcctggactcgagcgatccatttgccttggcctccaaaagtgctggaattacaggcatgagacactctgcctggcctgtttcttgtattttctacagcagtgattttcaaacttttttgatgtattgacacatatacaatactgtaacactcgtgacacctcctggagttttgcagcactttgcctacaaacacctgcaactcaaacaaaagttcgctgagctaacacttattttcactatattctcaggtaagaatccaaccttatggagggtggcaaaggttaagatttcaaaggagatggctaagcaagcaaaatgttggcctgtcacaactccataggtgctcaaagtagacaatgagattcaatgggttagagcatgagtctttaatattcacaatatagcaaatagcaggaacagtagcatggtagtaccagttcctctgcctcaagtattacgaggtgacacaagaggccaaaacggtgactatgcacacagtgggttgtgctgcagctggggaatacagggccaaggtctcaccatgtagtaaacaactaacaagacagtctcctttccctggagagaaaagccttatggtagtcatgctgtggtcacttttacctaattaattgcctacgtgactagctacagaaactgctcagtaccatggtatcaagggatgataaagccttagaatttgtcacacttaaaaaggacaggcagggttgtttatcgcccatgatggactgcccttttcaacaaacctgtgatacatgattgaattgtttattttactccactttgataaaatgctagtctagaccaaatcaattgacttcatgacccaataatagatacaactcacagtttgaaaatcactgccttagattcctagtaaatgccttgcagattctaattcaaaaagccattgttaaacaccaaatatttgccaggtagtgtgttccatgctcagaagacaatgttatagctgttacagcagaagaatcatggtctttgtaacaactgtagtttaacttcccattttgctatttatttagtcattgtttagtattttggtctttattatcttattttgttcttgcgaagttaaaacatgataatcttggtgaggcaccttgtgcattgccaggtagctgccaggtatttatcttaaataatctgccttccatggatttctttgcagtgaaatattacacataagttaaagaaaaaatattgaagtggcactttaagaaactgcatgaaaattgaaattactgattgaactcttgaacttagaaaacacaaatcatctatattaaaatttatacattttttctctctctctctctctctctcacacacacacacacacacacacacacacacacacacacacttacttgtattatacaaaagccagttaatgagatgtaaaataaacttgaagcccgatgtggcaaagaccaaaggaaacagaagaaagaaaaatctgagattaaaaaaataaatttgtttttccttatatcctataggtagctttgaaactttgtgtaattgatattacttactattcattaattttctggttataattctttaaagacaaagtcaatcaaaatgttatgtttgctgttttttgtacagaaaaaaatctcatttgtttcctctaccaataaaatgccatgacaatgtagaataaatatataatttacttcatagtgcaggattatgctgaagtatacatgaaactattgtccaatgaaactgctttggtatgataagtttttatataaatatcaacctggacacatccggtataatttttattttgtaatgtttggcttaaccagtgcactctctttgttaccatttacaaatgaccatgctagctatttcttcagtctatggagaaacatggaagcctaaaatatttttttaaatagctatttcctcatatctcctaggtaagacatatccaaagcacgacaaaagaaagctaccctgtctttatattaaatcttgttgaggaatatttatagcatcccagagttataactattttagggtgacaatgcaactgatgttgagcaattatgttctgctgctatatcctatgtctatggtcttaattattaaaaaccaagaaatataaacctaaaattgttgactgctacctaaagataaagatcattattaaaatactgatgacaagaagtttcattattaaaacaataatgtacaactatggattcactttaaaaacttggtttattcatctgtattcaagaaacagagttaatatcaaagaaggcaaagaatattgaagcatattaaggaatgctgtgatttagcatttgtagtcatgttaatggcatcagactataaaattataatattccctcaatttagccacgtaaaaataaatcacttaatgacaaaagtacatattttagcaatctgggatttcatgtggaagaaatattgatttgccactgcatctgcatgtcaactcacatacttgagtaaaaactagtatttctgagaagacacgaaatcactttgaacctattaaaatggacaaaagtgacaatcagttgatgatatgaaatgcggtcttttgagccaaactttgacaatttataattttctgttgtgtgataaattttaaatggaaacagttgcataactcactagagtcagaacatacattataaataatttagtccataccctttgattaatcgataattgggaaataagtgaaatgtcagaagtctgccaagtagttattgggtgagccaagactcaaatctagataaagtatttattctactatacaaattaatgtcattaaaattattgctttatttatgtattcacgtgaatattctctaagtgtttttaaacacttacaatgtaccaggccctgtgctaggacctggggataaaaatggaaaagatatgggtctgtcatctagagatactgtggtttagcaagggagtgagctactaatatgaagaaggagaaggagaaggataaattattatagtacagtatgataattgtgctaaaagtcatcacagagttctaggattgtgcccagtaccctttgactagtagagaggggagaggtctcacttgaattacatcccttcttatctggactgttgcatcttgaaagatctcgccacttccagtttgaccttcctccaaatatttcctccaaattgctgctggggtggtctttctaaaatctgaaatttaatcagagcactcacctgtataagaaccatcagagtttctccatttcttcaaaatgaagttcaaattcattatcttatcatgagacctttcatgatctggctttagtcaatcactccagccttacttcctgctactctttcagaaacattctccaattcaaaagcatagatctacttatagtcacctctaggtctgggtcaaagagcttgagagcattgtagctcgaaggccaccattaactcaatgaaatcagcagtaatctttaaagaaaaaaaaaaaagaaaaattggcaataggagtcctgtgggagaagttaaagtttgtaatagtgactaagatgatagggagagaggaattctgggccgttaataaatcaatgataaggtacagttagggctaagcgtgcttttgtttccctaataatttatgtgtaatttaacaactaaattaattgaaaaccatgtttgaatctcaccttaccaactgcccacctggttgaaaattaaatactattgaatcttaaagacaggtattttttagaccaatttatatattttgctgttcatgttatagatttcaatttgacataataattcaccacaattaaaaatgttcttgaagtaaaagatatttacatgtctaacatatctaaatagcttgaaaaattacatgaaacattagtacatttttggagactcttatcttgcccttattttccaaaggataagttcttgaaattgagtaaacgacagaaatagcatagctagattataattttgaataatgctgaatactttctgatctggaacctgtaaaacgtggctgtagtgagggagctactcttggttgcacaagggaattgggaactgattgtggttacgtgaaaatcgtaaatgtcggatctcagtttaattgtggtagaaatatgtggtagatgattctgagtattaaacagctgtgtaaatattggaagagcagaaaatctaacataatacaacaaatacatagatcttctgatgttcttctttttaaaaagctgtaaattaaaatcctgtgtaggaaaaataaaggtaagatgcagtgtacaaatcagggtttctcaactctggctacacattgcagtcactcagggagatttcaaaataaactcatatctgggtcccactgctagacattctgcatcagttggtctgaggtaatggctaggcattagtattgcttttcttttccttttttctttttaagatgtagtctcactttgtcacccaggctagagtgcagtggtgcaatcttggctccctggctcaatgcaacctccacctaccgggttcaagcgattctactgcctcggcctcctgagtagctgggactacaggcacccgccaccacgcccagctaatatttgtatttttagtagagatggggccaccacacccggccttagtgtatatctgtttctgctgtgcaacctgagttgagaactactggttaacatagatgaaaataaggttcatatatttcagttataaaaaataaggcagaaaacttatccaatgttattagaatttttccttgcatagctatcatgcaatgatgtagttaacaaaaattaaattgcttacctgcaattttatgatgaaactgaccaaacacaccttccaaagatcaatggaatgaaggcaaaatcagatagaagtgtatttcactgtcttttgtgatttcacctctacctgactaaaactactaatgctcaggagaacgaatcaactgacagtgcatttttatataccccgtgaaggtctcataaataagacatggctgaaattaggtaggaggaacatttatcttgaaaatccaaaattcctaaagcaagggatcatatactgcatatgttaccgtcattatgccaaaggagcaatgtatacacacacatacacacacacacacacacacacacacacacacacacacacacacacacacacatatgacagacttctccagctctctgaactacaagatgctttataaaaccttcacatgggccaggcgcagtggctcacgcccgtaatgccagcactttgggaggccgaggcgggcggatcacgaggtcaggagtttgaaaccaacctgaccaacatggtgaaatcccatctctactaaaagtacaaaaataagccaggcgtggtggcatgcgcctgtaatcccagctactcaggaggctgaggcaggagaatcgcttgacccaggaggcggaggttgcagtgagccaagatcttgccattgcactccaacctgggcgacagagtgagagagcgagattccgtcaaaaaaaaaaaaaaaaaaacctgcacatgtatatatttcaccaaacaaatataagcacaaacaaaggaatgcagctgtcttaaatagtccccatctatttggtgtagatgtattgcaccatttttccccggtgcaagaagactagacatgtttccaatagaggattcacctcaaagcgttcagctttgccaccatcaagaatatttgaaagaatgtgccacacaaacacaaaaattaacacttattgtgaggccacaaacgttagctgaaacctcatttctgcctaacttctataaatattggcaatttcattgataaaattttgatacttttccagcttcctaggattcttgttaggattaaaaactaagctccctgaagggagagggttttgattattttattacctgctcccaagcctctggaacaatgtttagaacttaatgctaggtcaatatttgttcaatgaattattggaacataaggacatatgactgactaccttgcacttaggagttgttcagaaaattgtagttagtattatttctcttttattttattcatttcaagagatgcttgcctaacttgagttgccaaaaaaatgagatgggatactaagacagcggaaatgggtccttcaaaaagattgtctgtttctatattgcaatgatatctgaaatctgatgctgtgataagaaccaaaaacttatcaggggtggaaggattttgccctgaatgagaggaggccccggtgaagatggtgtcttataatatttggtcatcatatgcagggctggcatcttttaaagtgtagcagttttagacctagactgaaaatccattatatgtgtcgtattccaacctcttcccaaacaagactcggattgtctcctatggtttctggtcacaaaacagataaaataaaaccatccctcctgttaccctattcagaaactctgatagcattcttcatatctctcattctcaatataaatcactctccaccaaaatttgtttattctccttgtctctactcagacacctgcccaaccctactcaatgtaatattttctatatgttatagccagaatgatctttcataaaggtaaagttgataagtatcctgaagttttaaaaaaaaatggtacattctctttgcccttgaggtaatgtcagcatactttaaaagacttacaaggtttttcatcattttgcccctttggactctataggaaaaatacgtgtatgcacacacatacacatatgtgtgtctattttcatttatgtctaactgaaatttagtatttgcttcatttggaaatactagccacactaattagtggctattgaaagaaactgttactttatcacttgaagttacaaatattttcttattatattatggtttttgtaggtttctcagatattatttgcattcattgtcactccaaaattaggcctgccactatctcctgtcatgtaagtgtcaataaagaattacatgttactatattgcaaattcattttattactttttttttttttttgagatggagtctcactctgtcacccaggctggagtgcaatggtgcgatctcggctcactgcaacttccgcctccccggttcaagagattttcctgccttagcctcctgagtaggtggggttacaggtgcatgccaccgcacccggctaatttttgtatttttagtagagatggggtttcatcatgttggtcaggctggtctcgatctcctgacctcatgatccacccgcctcgtcctcccaaagcgctgggattacaagtgtgagccactgcacccagcctattatgttttgattattgcctttcaatataactggttttcatcataattcaatgaagttttattttgtgcatatataaacattccagaaaggcatccataatcaccaaatgccaaaggagtccatctctctctcctgtacgcacacacaatgttaagatcctcaggactatattgtaataccttgcatattattgttcacttgttttccatgtaaaatgtttacaccattagaacaggttttgtttcagaatgataacctcccagactgattcagtagggactaaattaatatgcatctaattaaattgaaatgaaacaaagccccgagatacggacagaatttcagatggtaattttgagaacacctttagcatttagtaaggtggtactctttaaactcatgctatgttgtcagtattaacatttccaaagtcactaggtttaaattttagagacttactttctgactaccggctccaagcatttattttagcctatgtgtacaaacattcagactggctatgtgatggaaaagtaaaaaaaaaaagatgacttttgtcctggccctcaaaatcttatagcttaagatctaattctccaaaagtagacaaaagttgcttgagtattgggttgcacttgtttgtatagtttttattcagataagaataatgaagactcttgttctctctttctatctattcctttataataatagtaatcatcatcatcatctcaggcaacagcatcctcaatgcggtaaattttgcctatcatataaaaaatacatttgaatatatagttgtatcatgtttactttcacttttttgtaacatttcaaaaagtattattctgctatgacattttttgggcttagtcatagaacaaatgtgagctgttagggaactttaaatgtcttagttttattgtttatttataactaaagagcatttttagtctactgtaaaggcaagttatcatatgctaaacaacataaaaatgactgaatattaaagttaaaacttttttatgagaaaatgagagacccctatgtgatttattttaaaataatcattgcatatgccctcacacagaaaatcagaatggtgtgattgttgcctgcatgaccaaaatcgattctgcctcctttgtggttagccaacacagtgacttcagcacctagtagacacaggttgtgtagttgtagtggtgcatccttagtgttatgctctccattgctggcaggacagattctttcatgcttgtcttctttaaagcattgacttaatttttcaactgaaaacagtaagtgacaaatggagcacagagtattttagaacatacccagaaagagcacttaaagacaataagaaatactcaaataattgaaataggaatatttttattattatgtcattaaactagctggtgcttatctgacatttccatgttagacatccgtgcttatctaacattgtaatgttccacgttccaagtctgttttatcttgacctgtgcactattaagtaccagcagagagtgatcaatattattgtccaaagcagtgcatcacaacctttactgggcactggaaacacctgaggatcttgttaaactgcaaattcggattcagacatgaggctgagagtcttgtaaaagaaaaattgaacagatcggttaaacaggtaaagtagactttattgaggactgttgtaataggagagagtttcatctcaactcttccactgaagcaaaaggtgaaaggatttttaaatgctggggtgagctaatggaaaagtactggaggacataggcaggatggagaatgtgattgggctggttaatatgattaggccacctgtgtttgctaatggtaccttatcaaagttaggctcctacactcctatagagactgggaagtagggccctatctttcttgatgattacatttcaaaggattggcgcccaggtccttgagaaagaatttcctaggttgtagaaggtttacatctgaaaggggcagagaaggaatttacaattgcaaattttccaaagtaatcgctctacaaaaaaggaggtaataggcctatctatagtcagaaagaagcttgtctaaagttgggagggggggaccattaaggccattgtggtcagtcagtatttctacaaactcccaggtggtgtcaatgccattggtctgcaaaccacaggtctgcactgttacactgataggaaagattccatattgatgattcatgttaacgcattttctagcttatacagtgtactgtatatagaagtgtgtatttgaaatggtcaataccattgtctgtctagatggataataaaagttgttgtgtacaatatttatagaatgatatcttttcatacttctagaggcctactcagaacatctgagtctctcctgatgagatgaaatttggaataagttatgtcccagaattcaggacacatttgatgtttaacttatttcactatgagaaaagtagtgttataatgatgttccacagttgtattttgttttaattattctcattaagcccctagcaaacaggttgcttcatcatttttttctttctttctttttttttttttttttgaaatggtgttttgctcttggaatgcagtggcacaatctcggctcactgcaacctccgcctcctgggttcaagcaattttccttccttagcctcccgagtagctgggattacagtgcccgccaccacatctggctaattttttttgtatttttagtagagacggggtttcatcacgttggccaggctggtcttgaactcctgacctcagacgatccacatgcctcggcctcccaaagtgcagggattacaggcgtgagccactgtactggctgattcgtccatttttaacagatgaaaaaaaaactgtaatcaattttggtcagtgacagtgcaaaaaatgcaatttaatactacaaatacttattacctgataaagttctcaaataatgagctaaaatagaatggatatgccaaaactgtagcaaatcattaaagacaaaataataacattccagggacttaaaacaaattgaattctccaaagaacattattataaactaatattcctaattgcataggaatggaagatttttttttttttaatgttagtcataggagtttcaagacatttgaatcacctgcgtggacactggcttttatcctattaaatttaatgtggtaatttagagtgtttttattagaataatcaacattctaaaatgcaatcattagcatatttggcatagaaaatagatctgaaatgaacccaaaaaatgagctttaaaaattgctaaaactagcagtgtataatggtaacacaatccaaaggtcaaaaaacacaatgattaattaaaactaaagaataataattaattagtagtattaagaaagctttgcctccttttcaaaaaaaaaaagctaaaaaggaaagttgttgaatgttattgtttttaaagaccagcttttcatgaatgaagtttttaatcctttcaaagcctaatctaaatttaagaattcaaacaaaaaatccctaatattttaatttgcaatcaggagaggttcaatcagactaagactttttaatttgacagtctcctttttaacacatagagctacttctttgatctgccttggttaatgaaatggatgagttccaataaatttggatgcaaagtaataatcaacagaattccatttcccattgattttcattgtaaacttgtatcacttttttgacataaaataagcactctctggaatgaataatttaatttgaaatatgaataaaaaataaattatggtgcagaatattgctaagtccttcatacatttgcagcactttgcatctaccactgcttacttcctagacagagaaccatttcctataataatagctaaaacccatgaaggatttcctatctggaaatagtttctataacctttacatctattcatcttcatgattacattgtttaatgggtactatagagatcgtcagcatccccattttacataaattgtaagtgccagagttttggtttaaaccaggttgtctgactccaaactcttcacttaaaaaatatattttatttttatagataataatacaaatactgaaaatatttacaaaacaaatttacaggtaatgaacactcttattactaatgaaggcaaatgcctttattactatccttgatgtcagaagctagaaccttgcgagccattccagaaactttccacgtgccttcttataaccatctccggacacacgcgtgcacacacacacacacacacacacacacacacacacacacacacacaactgtgaccattatgatgattttattttttggaatggcatccttacttttcttcatagttttgtcactcaaatatgcatccctaaacactgtagtttagttttgcctagtgtgtgtgtgtgtgtgtgtgtgtgtgtgtgtgtgtgtgtgagacagagtctcaccctgttacccaggctggagtgcagtgatgcgatctctgctcactgcaacctccgccttctgggttcaaacgattctcctccctcagcctcccgagtagctgggattacagatgcgtgccaccacacctggctaatttttgtatttttagtagagatgcggtttcaccatgttagccaggctggtctcaaactcctgacctcctgatccacccgcctcgtcctcccaaagtgctgggattacaggcgtgagccaccgcacctggccagttttgcctaatttttaaaatctattaagtttcttttaatctataggtttcttcctttatctttttcttttatttaaacagtatatgtgttgaggaagctaaatagtttgttctgtagtcttccgtggactggcttttgctgcctgtgtttttgtgatgcaatttgttttgtttcactatcatccgtattccctatctgccttgttgccttgcctgaagatcaccaaatttcaaggacttctttcctgctctgctccaaggcacttctcagcccactctggatgtgcgtgggtggtggccagtagaggtgggctgcaattactggcttctttagtaagagctgtgaggttacatatattcaactctgggtttctaaaggcccatccaaggacaagttccagggaagatagggcatgcatgagtttgaggcagaatgagaaaaataagcaacatacaatacattttttcataaaattaaatttctccttttaaagaagtgttctttattatatttcagttagcctactgtttcattggcatcgtttccctttcattgtttgtatttttgttttggtgaaacaaaaaattagaaacccaatgtcagtctttgttctcttcttatgatgctaatttccaaaattgaaaagtgttggaaactctgctttagccttaaattttctgcagaaaattacattttgaattttcataaaagaaattattggtcttaacccattctgtatgataatttttaaaaaaaaaaaactctctaaagtgtaccttgaaaaatagtacctgtgatttgtctaagcttttgaataattcattctatctcaaatgtatttctaccactaaagttgctataccactttatggaaagaagaaaagcaactttccttttttgtacaggaaacttgaaagttcatctcatggaaggtgtggagagaaaggtggctatgtaattctcctttggatatttctggatctgtttctcaatcagattggttccgttcacactgcctgctgtcatgaaagtttatgcctcgcatgcaatgccagcataaatttctcagcacaaaacagctctgcttgttaaggaagatgttctgaattatcaaatatatattttttaattagccaccctttcttatgctttcagaatatatattaaagtgatctggggtatttcatgttaatgtaagaaaaacaatccaaactccctttgtttcttgacttagcttattatatcttcagtacttgcaaactgtgtgatacatgatcagtcacagcacactgctatttactgagcatccatggccactggctgacgtggcattgaatataacattgtattgttgctctaagccttttagccttcgtgctaaatgactcaacccatcacaagaaatttataatggacatataactcacctagttagtctgcatgagattgatttgttgtgaagttattggctataatgtctttgagaggataggccttcatttcaaataaagacagcctcatttatggatttcaaagcatgtctatacactgtaagtctgtattaaagaaatgggatgaagccagctgttaaaaacaagaaaatatgtgcaaaaggatttggagttgactgtattatatagaagtattaaattaggagctttagggcatactgaagcttcatattgtttgaaagtttattttgaattctgtagaaaaatgagtactgttaattaggtgatgtggtttcagcattctcaggcgtctgctccccacagtatcaaaacctttgcccaagtccactcactttattgtgacccctgtagatgctctatcattatggtccctttaccaaaaaaaaaaaaaaaaaaaaaaaaaaaaaaaccttgttgtctctcaggcaaccagcgctttttgtcagcctatttcatctccccatcccttcctacaatcgtttatactactgaaaacttgaaagcccacatcccattctctcctggatctctaggcctaccaaagtttctttctaaaaccatgaaatgaccacaagttaatttgatgaagtgattcataataaattgttaataagaagtgacctacaactaggtcaggtcattcttcaaccacctattttattagtgatcccccacaggcaatacatgtgactgaagctggaatttgaactttctgtgatgagggccctgtagcgtatatgtgagacctctggtagcaggagtctctgagagcctctaactcatggtagtctgaaatagacataggcaaagccccagggacatttttaagagagctgttgtaagtaatccagtattataagttaagtctgtcctgtattcatcagaaaaaaacagaatctgctgctacaagatattaggatttctggtcttaagcaacagacttgaatttcactacctggattcttctctttggcttcatgtttgcagataggatggttgaggaggatggagctattgagagggtggctgctctgtgcagttgcttttgtttatattcttactgacctggcacagtgtaggtggaggtgatgcatgttttctgacattgggccagtgatgtatggcctgaccttcaaaatgagaaacatcatctctgtgggtgagactatagccgtgcaaatgcttttatcccatattgctcagcagtttgcaaccggttctgataaaaagcacccaccccgctgagttcgctgaagcttgtatattggttttaggttgaacattttggcaaattaacgactgagtgaaaccataaaattggttttatttacaacaaagccttgtggtgtctgttggttgttcttacatctctttcctttaatctttgaggttgtttctgtaggtggcttatctaactttacattgaaatttgcattcatttcaggataatacttcccctgggtttcttcttaattgacattggacatggtctgcattctcaaactttgtgcataaagttggtaactatacagagtcctagtttacgcctaccccaggtgattctgattcgggagatgtgagatggaaacccaaactacacattgttagtcagtaggtgactcccccagtgtgaatctactgatctcatgtttagaaatactgctgtataccatgcaaagctgtcattttctaactctgctaaacaataaaggttcacaagccatacttctgatttgccataaagttcgagtttttctccatttggttcaatggtgttgctatggatggcattcatagcaaatgataagattgggcatagtatactttgagtgaattcttagttttccttagaacaacaagataatgagttagaattataagagagccatctagtggataaggatataggcctgttgcatcttgtcttaatgtcggctttatggttttatcagattacagatttaaatataaatgaaattaagtgtagatatatactctgaatatattacattaaatatatattaaatgttagtgaattttgtttttgttctttttgttttaaaaaaataatttcttattttataaatgagtctgtacttttaagtagttctactcctttaaatgaaacatggatacagagatgataagacatgattttaccgtaaaataaaacacacattatatttttagggacataaatataggctagtaactaaaacatattttttaatgcctactatatgttccttggatttgaatgtaaaagagatttcaggacttaaatagtagtttatgcaattagagaatgcagaaatagcgtgaaagaattatagtctagatacattactattttttatatactctggaagtttttaacagttcgtaacaaatgccttgggcagattagggcattgccaaaaatcaacatcatgctacttacatttacaatcatctgacagtcatctctcagacgagcatcctcctgattgcctaacatgtttcttttataatgtaataaaggtgagttacacatttgagcaacagtgtttgtctgttatacctagagagaagaaaaaagattgtaggagagcaagatacccaagatactaacttttccaggcccacattttaagtgtattgtcaaaagaagcattttatttttatttttttttacttttttattttttttgaggcaagtgtcttgctctgtcgcccaggctggaatgcagtggcccaatcttggctcactgcaacctccacctcctgggttcaagtgattctcctgtctcggcctcccttggagctggggttacaggcacccgccaccgcacccagctaatttttatatttttaacagagacagggtttcaccatgttggccaggctggtcttgaactcctgacctcaagtgatccactggccttggcctcccaaagtgctgaaattacaggtgtgagccaccgtgcctggccgaaagaagcattttaaaagtttgatattttaaattaaattgaagatactctatcacaacttaacattcttatgctgggtcatccctccttcccctgtactcaagctcctagaaatctcatctatttatacctgactctgctattcaagtaacttccaggttttcttcccccagcgctacatcttttcttctcttctccaggatcctgctggacatcacttcctgatattcttctggcacctcaacatggcccaaatcaaattagttatctttgcactgtttttgtattgtgtatttcagttaaaggggcttacctttaattttcttaagaataaaagattatagtcttatttaatctttctttttttcttatctccttcccccagtttcctgttggttctacctctaaaacctatctggcatcattcatcaggatactttgcaaaatgaggattatgaggtcaggtcctgtggtaagcagggagccaaaaataagaccctcagagtttcttgcctccctgttgtacacacccagtaaaatccccttcccttgagtgtgtatgagactatgaataggatggataccacacccccgactaggttacgttatacagcaaaatggaagataattttgtgtatataatttaggctgcaaatcagttgattttgagctaatcaaaggaagattattctgggtgggcctgactttatcaggtgaaagcccctaaactaggaactgggctcttcctgaagagataaattctcctgctaggaatgaagtactccttgacaaagtaagcagccatgttgtaagcgggcccatgagagggccatgtggccatgaatttcaagtggcctctaggagcaaagagtggctcttgtctgacaactagcaggaacagagatctataaccacaaggaaatgaatgctgccaacaaccacatgagcttggaagagcacccaagctccataaataaatgcagcgtggctggcacctcaatactgcttcgtgagactcggagcaggggacccagttaaaccgcacttggactcctgacccacaaaaactgtgaaataataaattcaggttgttttaagcactattttttaatttttaatttttatggatatataatggttgcacatatttataaagtaagccactaaatttgtggttatttgttatgcagcaataaataacaataaatgtcctcattatcttttgctttggatcagtgcagtaaccttcaaatgaagctctcttagctcatccgtctccatgaaatcctacataacacagccaaagtcatcttccttatcctacataagacagccaaagtaatctcccttataaacagactataatgtaacctccatgagatagggttatagatagagttttgttcaaagctgtatctctagaagaacgctaacatttatgcatgctataaatattgactgatggactcaatgaataaatatcatctgtcctcctacacatacatcaaaacctttgctggtcccttgcctacagagacatcctccagatacaagaagagggaaggtatataataaaatgcttcagcatacaggttctagagtaaaaccttgggtttagatttcagctctaatatttcctagctttgtgatctcttggaagatgtatgactttactaagcttcggttttccaatttataaaacatgaataacttttaccactcaagactgtattgaatattaaataagacaatgcatttaacatattttcacagtgcctggcctatgcaatagatcaacaagtattatttatgattataacatttaaggccctttactatatacctttccttcctgtcctccagccttatgaagctggcacccttgtgtttcctgcctttgcagcatgatggagagtgagatgcatggatacttttaaagtgtccacttctacgcatcccctgctaaatgaccttgagcaagtttcttcccggtctcagtttggttatctgagtaatggggctaatttgaatacatagttctcgagtttgtattgagtcgatccctgcattagtcagtcacattgaacaataaccaaatattggccactgaggtcacttactgcaggaacaatataatggacgtctttcataacattatgaagacccatggaaaacttttcttaatattagaaatagttgtgttggtactgaacaatcaacggttgttattgtttttatctgaccaggcttttctctttgaattagcttctagttgagacaatctgtactgactctagttcagaccttgttccctgtctctgtgtatttccttttttctcgttacaaatttctaatttatgttttcctgctatatttaggtaagttaccttaaattcattctttaaaaaaaaggtagaagtaagtatataaaaaccttccatggttgttacatatgtaacaagcactattcctgtgtcatttgtgtgagggtatgtgtgtgttttaatggtgagagttaacaaattatgtaagaaacactgacattggaaaactgattttaaaaaaacaacttgcaaaatttcatcaaatgagtcttgtttcttgcattgaacagatcataaaagcaattcataaaaaggcaaatatagtgattcttacatcacccatttagttaaagtatcccaaatgctatagcataaggaagtacatgtgctaggcagcctttgagttaatgaactgatgttgatgttaaaactggtgcactcttttctcccggaggtatggctgaatctgtgccacagccagccactttttcatcagattccatttgaaagtcaattgatgaatcagccctgatgcctcattgaacataatgtcgagaagcaagatttctgtactctattgatgtgtttaagcagcatcaaacaagcacacacatcaatggaaatatcggtcaaatcatttgtcaacaattttatagagaatacagttgacttcctaatttctccactgtttgggttgctatagtctaataaatcatgcttctgcatggagacatactaatacttcgtggaaaagtaatcagaagtcttaattgaaataaaattatatttgtccctgtttaaagatattcaaacactacttcagttcacagacttaaaagtgaataacttctttatgaccttattgaatgaggatgtgattaatgttactaaagtcacacttacgttggattgggggactgaccgaccatgctgtgagatctttagcgagaaaattgagctctcttctggttagcgttgactggctatactttgtgctagccatcactgacttccacctaaaaagataaactgtaggtgtaagcagcaaatatcaagccgtcttaggctgtattcttctattccttctctttttttttttttcctttctttttctttttttttctttttttttttttttttttttttttgagatggagtcttgctctgtcacccaggctggagtacagtggtgcgatctctgctcactgcaagctccgcctcctgggttcacaccattctcctgcattctcctgcctcagcctccccagtagctgggactacaggcgcccaccacgcctggctaatttttttttttttttgtatttttagtagagacgggggtttcaccgtgttagccaggatggtctcgatctcctgacctcatgatctgcccaccttggcctcccaaagtgctgggattacaggcatgagccaccgcacctggccccattccttcttcttcttaatatttttccatttcaaggtcacaactgcaataccttatatatcccatattagtaatgaggacatctgtgttgcactggtattgttaaattggccttcagtaaaatcaaaccattccttgcagtaatgggtgagaacttgcctttcacctagagccaagttcattacaaattcatgctcacagcccagagaaaaacagggtttttatgaggtttcaacaagtaatatatctgcatgatgggttgttccaagaaactaagcaaatggaaatgtcagtttgcagaaactgtcaaaacgaacataacctaattagaattgctgcttatttaataagccatcagtagccctaccagatagagtcctgccaatcttgcaagtactcattcatcttgcatttaagtttgtagatactctaggctctgctaatgggaaaacaacgttaattagataccgcacccaatcattaaacagctgcaagcatagttagtgcccttagctatgaaatgctgtaagccttcatgtgaatataccttgatatgtcaacatgggaccccagtgtgtattgcagttataaaacagtgtgcatcactgtatgctttgcacatggcagatcctcgcaatgtacacatcgataagtagtttttattaatgtatattccatgtgtttgaattgcatgtcacccacttaaggtaggttcttatttgatgcccgtagtgtttgcatattaagggccctgaatactactactttgcttagtaacgtgtctttacagacattacctctgacttcatgttttatggttgttagtaattgtgaaacaaatgtgtctgactgccactgggcaatgctgcttcaatagagtacacacattaagtgtatgacattcaaaactagcagaggaggaactctgaaggaggtagggcaggggatgacaagagtgtgggaggaggagaggtgtaaggagaggtattatgaaagaaaaaataatcatgcttttttaattgcataaaataatttgattgcaagtttcaaagacaaactaaaaaagaatgtaatcaattatctgcgtgttggcacaatagaaatttatggggagactgtggaggaaacgaaatgagaacagctgaatgaagtcaatcgctgtgatgtggcgccttccctattgttgagaatggaaaagagtgcaaatgcacagtgcaccggatttgtcagcaagctgtgttttctcggtatggtagatctctattgctcatgactattgagaaagacctacacacctgcttctgttattctcaagctgaatgatgaggacagagtttataaatagcctttctttcctctctgttaagtgtttcctcatatgtgggagaaggtagattatctggctatctaaatatcacctggaattgttacaccatgcagtgaatgtttaagaaatgagagtggacgattttggttgatggttttagttagctacaatgttttcaacatctttaatcatattatccagacttcttatttgttcttcctgtattacctattgattattataattctggctccatatacctgttacctagagtcacattgatacatttttgtcatcatgtgacattgctttccctcaatctcatatgccatttctaatctcattcttgctttactgtttactcgattacatctgaatctgggaatcactctctcatccaacataacagcagcccctcacatggctcctttgcttctaacttgcctcaatttctttctagccagtagagatcaccaagacccaatttggtcatccattatgtttgggaggacagaaatattattttagttatatattcagtgacttacaattgtttatcacaaacctaaagttacctgtagtaagcactggatctgtttcaggtacactgtcaattgtagaaggtagttgtggacatgaataaaatgttagagatgtcagaggccgatgtggctgtctttagaggtagagttttattggaatatggcctagaactttattttcaaaacaaaacaaagaaatggataatcacctcttttccttatcaatgatctcttaatctctactgaattagttttgcaaattatcactgaaagaggatttcaagaaatatgattttaaattatctttttcatatttctctagattttaaaaagctttctttaaaaagatgacaacctttaaaaataacttttagataccatatatgccttccaatctaaaaaaaatgaaaatattgataataaaacatttttctccatggtctgtgttaaaatttatagtctgactcactcaatactaatctatgtggaatttatcttgggtagtctaatctttgttgcaaaaagtgcaatacatgtcttccttgctttaagtactgctttcttatgtgatagaaaactgttacaactaaattacattatttttaaaaatatgatattttttaaatggagatctttttgaatatcataccacattcaatttccagttaatcaaatggcaagttaaaaataagtagtgtgcattagatttttattgctgcagttgtaaattaccaaaggcttagtggcttaaaacaacataatgttattatcatactgacacaggtcatactgatcaaggtctcagcaggactgtatttcattctggaggctctaggagagaatcagtttcctttgccttttccaacttctagagcaagtttgtccaacacgtggcctgcgggctgcatgcagcccaggatggctttgaatgaggctcaacacaaatttgtaaactttcttaaaacattgtgagatttttttttttttgcaattttttttagctcatcagctatcattagtgttagtgtattttatgtgtggcccaagacaattcttcttcttctaatgtggccaggggaagccaaaagattggacacccatgttctagaggcttaccacattcccatgacttatggcacctttcttcaatctttaaagtcagtaacattgcatttttctcatccttcttcagtagccatatctacctctctgactcttctgcttccttcttccacttaaggatggttattattaaattggatccacctggataatctaggctagtcttcctttaaggtcagttgattaacaacagtaattccatctgcaagcttattgccccctttactatgtagcctaaaatattcacaggttctggggattaggacatggatctttttgttgggggaggcattcttctgcctaccacatagtagtatataggtacacacacacacatatatatatatatatatatatatatatattttttttttttttttttttttttttttgaggcagagtctcactcagtcgtccaggctggagtgcagcggcatgatctccgctcactgcaacctctgtctcccaggttcaagcgattttcctgcctcagcctccctagtagctgggattataggcgcacgccacctcacccggctaatttttgtatttttagtagagacggggtttcatcatgttggccaggctggtcttgaactcctggcctcaggtgatccgcccttctcggcctcccaaagtgctgggattacaggcgtgagccacctcgcccggccttataaatatatttatacctaggtttgcacatggaagcaagcatcactattttagattatggacatcttaattttcaactttggcagtaggtttttacctgtaaaatgaaaggaaatcaacctgattatatactgtgtactttgaatccatttgaggcctacaaattgtttgtaaaaacaattgtttttgtccaactgctttttttccaactgcatatatgatttatggaatttgatgataagatcatggaatttttctcaaccaaaagtaatggtttgtgacactaatacatgaagcacattccagaatgatactccagattttaaaaagagtaaaggcaaaaaattgctaacgtctccaaacattttcctgtgagccactaaccattgctaatgtttccttgacaagtgaagaaaacaattattttttaaatattctgtcaaatggtactattttcttcaggtcaattctaaattccaaaatttcagggattatgagcaagctctcgatcgctctcatccagaatttatagtgtccgtgaaactttatgtgcagtacaggaacattttacattttggggttaagagttgcaatagtttggatgattcctctgcaaactgaaactaatagagtcatacaatacaggaccatgttcttaaggcaaatatactatatagtgaatgaaagaaatggattttggtaactccctttcgggctgaactgagtaagcagttcttcacacaaaggcaccatgatacagtgataaaaatggtgagttgggataccagaaacttggtttctggtcctggctctgtctctaattattgcatccttttaaacaagttaaaggatagctttttgcctcatttctctcatttaaaaatgagtttaagaggaattatcgctgaagtcctggatcatgcacagcttctgtgatgttataatcccagttttacatggccaccacatgcctaacatcatctgtggtggctcctggaaaaaagaggggatgtgagcaaaaaaaaggaaatacagcagggagatgtgatatgacaaaaatcttgctaccacaattgttggaaacagaaagcttactcaatcgctgagagctaaaaagggcttttatgcacatctccttgctactttactgttttctgagttcaattccaatggaaatggtaaatatgaaggggccttaaaaagaaatagcatcaggatgttttactatagttctgccttattgtatatggaatagacttgatactagaaaattgacagcaaagtgtagttctctatataacattttttttccccaactgcttttgtagaactgaaactgcactcccaggggaagataaacgatcccacaaggtgcagtaaaagtcagagaatgctattgcagtagggacaagatggcccagagacacagtctacccaacacccacatttaactgatgcagacctgcaaacagagagtcttcatgattcactcaaggtcaagaagccggttagttacagagtcagagctgaggctgtatttactctttcccacaagcaaggttcaactgttcctacttgaattgcatatgattacatacagtatgaaaaaggatttttttctgttaactgttgacaatattaacatcagtcactaattttaataatagtacttaattgatgctttgtatgtgctaaacagtcttgtaggtgttttactcaatatagttttattaactcatctaatcatcccaagaattctgtgaaataattctacgtacactcctactttacaggaggggcgcccatgccccatttaaagatgacatttgaacttagacactttggctgtaaatccagtgttcccaattgtgctataatgcctctgaacttaaatgctacaagaaaaatcaaactaccaggttggacctcaattatgattacagtcatatgagatgagccacttaattgtatggatctttagatatataacattttataacttgaggctcattcattcaacatgtagtgattaagcatctattatatgtacagggatttaccaggtgttataaaggctaccaaggataatgtaattgataatgctagtatgcgtgataaaatggtataattcaaagtataacgaatagcattaataacaacagttcttagatagtacgtatttaatatgggccagcctttttgctaggcaccttgcatatattatctcataattttcaccccagtcattaagccaagtcatatttttccattttagaaatgatgaaacagacgtgaataggtaagcaacttacccatacttacaaaggaagtgacagagttggtattcaaatctaggtctgtgtgaataacaacctcattttatttcaactactctgctttaaattagaaaacccaatcctatcaaaagaacacgtgaggcccctctccaggcccagctgggaggcttattgctgaatgcatggccagaatccattgtggcttctttttgcacagatcttacatgttccccggggggtttattatctccccatatatggtaaagaggagaaatcctggagttcatctccagtctttctgtttaggctttgcccaccagtgaaatttaagagcagagtattgcaaagcgtatttggaatatgttaagaacccttcattttgcgttcatgctttgatgcttcaacatccttctcattgtcctaattttgagtccacattcaaaaccagctgaaaccccttgaaaataaacccaaccgctggcatctggctccgcagccacccaccttgcttggtttgctttcaaattgcccggtgaaattcactggcaccaatcacaagtcctcatgctctctctgctcatcacctattaggtcaagcactcatgggttgtgccgtgttgtggccctgcatggcatactgtcaccctctctctgggacctgtgagaataagaaatgtcatcctctcaaatcactttctcttgttctcctgtggcgggaccaactttcccataccttaaccaacacctacattcttagaacagatggaatgaatggaaacgaagctacacaactttctaaacttgtgattctaacttcaaaagtaatgattactttttctctttcctgctgcttttctattttatctctcatttttctaacatcttttctctcatctacctctgaagatccactctacctaggatctggagccttccttaattcagtcactcatttagggactgtactgagtttcaccaggggtttcaccaaataatgatataatttcagctctttatgccttttgagtgacactcataggaagagaaggattgcatctctacctctaaagggtcttgaattgtgaaagagtttccctcccctcttctcttgtgctctacttcctctgctttcctcccctccttttccctctcccccacacatgtaaacattgtgtaattccatgtgtgtccctgttatctatttgtttctagtgttaaggtgacttacagcttaggggtacaactgtatatgtattatattcagatgcagacttgtcaagacaaatacagtcttcctgacactgatgcatgcagtcaacactggaacagaaagttgatagctgcattaaaatttttgcaatggctgccatagaaacccacgcaagagtgactttgcgctgaaatatgacatctcagggatctgtctggtgaatctttgacacagaaagagaaataaattagaaaacagttttccacagagccttttagatccttaaaacttgagtctcaaagcacttgaacaaagtaactatttggaaaaagaaaaggtattcgttcttggcatttttaaattcattgaatagattctccttaaatgttaatagcattttgatgggagaattactctattcagagcattcggctcacctcagaaatgatttaaaaattttatgttatgccttttaaatattaagcttctcattttccatcccatatcaaaactggcataacatttcagaagtcaaggtttaacagtcagcaaataaacatatttgcaaaactgttaaatgatgattatttttgcatttgatacgcaattgtatctacaatatatgtcttgaggaatatgtgttttattcactgcatgtatgcaagcaataaaatttcactaagcagactccatggcaaattagttacctgagtattccaattactgaggttcctcaaaccactagaactttcatcttttttttcagtcctttttttttaatcatactctaagtctgggatacatgtgcagaacgtgcaggtttgctgcacccatccacccgtcatctatgttaggtatttctcttaatgctatctctcccctagccccccaccccccgacaggccctggtgtgtgatgttcccctccctgtgtccatgtgttcttatacttcacctcccacttatgagtgagaacatgcggtgtttggttttctgttcctgtgttagtttgctgaaaatgatggtttccagtttcatccatgtccctgcgaaggacatgatctcatcctttcttatggctgcatagtattccatggtgtatgtgtgccacattttctttatctggtctatcattgatgggcatttgggctggttccaagtctttgctattgtgtacagtgctgcaataaacatacatgtgcatgtgtctttatagtagaatgatttataatcctctgggtatatacccagtaatgggattactgggtcaaatgatatttctggttctagatccttgaggaatcaccacactgtcttccacaatggttgaactaatttacactcccaccaacagtgtaaaagcattcctatttctccacatcctctccagcatctgttgtttcctgactttttaatgatcaccattctaactggcatgagatggtatctcattgtggttttgatttgcatttgtctaatgaccagtgatgatgagctttttttcatatgtttgttggctacataaatgtcttcttttgagaagtatctgttcatatcctttgcccactttttgatggggttgtttgtttttctcttgtaaatttgtttaagttctttgtagattgtggatattagccatttgtcagatggatagattgcaaaaattttctcccattctgtaggttgcctttcacttcgatgattgtttcttttgctgtgcagaagctttttagtttaattagctcccgtttgccacttttggcttttgttgccatcgcttttggtgttttaatcatgaagtctttgcccatgcctatgtcctgaatggtattgcctaggttagggaactttcatctttactagatgaatcaaacctggcaatcctcagataccaaaacaaaaacaccttcatatacatgttagccctcatagaattcttcaaaggcatactttctgtcttaaagtataaaataattcaaatataaattttcttttctcttgatgattctgcaccgtagtacttttgggtgttagtgtaatctactggtgcttttgtgtagatacaagatgcaagtcaagaatcagatttgttgtcatctctcatcgctctttttttttttttttttttttttttacaaatgtaaccttgtgcaagatgcctttagcaatcaatgcctcaagaaaaaaagagatgattgccaagtggttaattagccttctgccaggtcttccccacctcagcaacctatttaccaacatgcaaacttgatgcccactaacagtggaaaagtcttaggcctttaggggtcacagtgatgaggtacaggtgactctttacccaccccacccctgatagctgatctacctctcatcatccttctagtcatgacttcaaattaccaccatgctgcctggacagctgatgaggggattttcataacagccagtatggctgctttgaatgattgccatggaattttttccctcttctttcggtttccctcccttttactttcttctatctcctgttgctactacaaattttctgtgaaaagctggtttatatatagattaccaacccatcagagaatacttttgctttcaagtaggaaatcaaataatcatagcatactgggtactattttttatgggttctctcttctatgttgtttattacttggattcatggggatgcttcattcttcccaatgaggtaaggtttccagccctctttttgtaaccataattgttttgaagtctagagctgttcccaaagattgagagttctgaaagtttggcctcaggagtgggtggggtgggggagagtagtaggtaagctgttgtgtgtatatttatgcttattgtttgctcagcaagcagtagacatatacttgaattaatctggcaaagtgtttagttttaatgtaaggtgaaacacaggaaaatactcctatcccaaagatgtgaaaaaatagtttgttaggggaaacaggaaagagcagctctacaaccaatgatatattcatatctaagttgaagtcatatattctgttttatgtggagcacacaaattagctttgcaagttggtcggctatgcctagatatttactgtaacatatatttttctaaaagcatatatgggtgccttaaaattaaaatctgtaccacaaggaatattggatattagaaattatgaaacaatagggcttatacaaaagaggtatgtttattcatttacttactgttttttattggatacatgtgattaaaagaaaaatttttatataatcctattgtctcaaggacaaatgattctgtgctcatctgggcatgggacatgtcacacagatattaaagacactacagagccatactgaaataacacggacagagaaataaaaaaaaaaaattaaaaacagggtcaatagtggcaaaaagtgagcttgttaaaaaacagaattggccaggtgcggtggctcatgcttgtaatcccagcactttgggaggctgaagcaggcagatcatgaggtcaggagttcaagaccagcctggccaacagtgaaaccctgtctctactaaaattacaaaaattagctgggtgtggtggcgggcgcctataatcccagctactcaggaggctgaggcaggagaatcgcttgaacccagaaggcagaggttgcagtgagccaagatcatgccactgcaatccagcctggttgacagagctagactctgtctcaaaaataaataattaataaattaattaaagtgaaggcatgcaaaatatcctctttggagtctaatttagacatcatggaaggataattatttggtggtggggatgacatggagattaaaaacaggagaaggaaagccctgtgtgttttggcattttagacatttagtggaacacactagggttcttgacactttctctgtaacttggagaggatacttttatattgtagataaccttgtggagaggtagaagaactatggtggagtctgaagaagtaatacagttcaaggtgtttccaatttgctctaagttagcaaaagaaaaagacaaacacaaacaaatagaaagtattggctgggcatggtggctcacactagtaatcccagcactttgggaggctgaagcagacgggtcgcttgaggtcagtagtttgagaccagcctggccaacatagcgaaaccccctccctactaaaaatataaaaaattagctgagtgtggtggcacacgcctgtagtcccagctacttgggaggctgaggcacgagaattgcttgaacgtgggaggcggaggcagaggctgcagtgaaccgagatcatgccactgcactacagcctgggcgacagagcgagacaccatttcaaaaacaagaaaaaagaaagtgttatacaagttatatcacgaacaagataatataaaaagctattgcacatcaataagaaaagttcaactcaatgcaaaaatgcacatatgatatgaatagacaactcataggaaaggaaattcaattgactttgaaatatatgaaaatatattcaacctcatttgtaataaaataaacataaattaacattaaacattttacccatcggattaacaaagttaaaaaatggtatagagaattaggtgttcgtacactgctgatgggagtttaattgttacagcctaaattcaggcaagtcagcaatacctatcaagaacaaaatgatgcatattctttaggcaattctcaaatgtatcttgcaaatatggtcattcatgccatctcatgctcattcatacacattcatgccgttgtgtgtctgtgtgtttgcagccattgtgtgttgaattgcataagattggaaattactgacatatacatcaatggaggactagtcaagaaagttataggtcattcacaaaaagagactattctatatctattagtatggaaagaagttgaaaaggtatcattaaatgaaaaagtaggggattcgaaacaacggttatagtacggtatttcttgggggaaagaatacacatattgtgataatggaatatctctggcctgtttatacttgggtttggctaagggattgtctctagggaggggaactcggctggggagattggagtgggacaaaaatttacttttcaatttacacagttttatagcttttacattttatatcttattgtatggtcaactcagaaagaatagttaaaactaaagggattagaggaaattatgaattctaagaacttactttgtctgggaatttaactgtgcattgagctagaattatttttgttgtattaggaatctggtaatagtgaacatgaaacaggagagaaaaatttttcacagatattttgacatcaaactgagatcatttgatagtttttgcctgattaatattcttaaatgattatggagaaggtgttgtgacccagaaatgcaataacccattatagtatcttgtttacaccccattaacactgatagcactctatgttactttattttcaatttttttccttcagagtctcagttatttaaccattttccaattactaagcgatatatgaatctgactcacattctatattcagaacaatgaagatcaaaatatgtatttcttatagcagttatagattacaatagtggaaaatgggcttcagagtatgaaaaagtggagagcaagtcaaaatcttatatgaatatgagagaacattttagttataattacaaagccccaatggcctaattttcctcattaatgctgagtgatatttttgaaaagtatgtagaatttaaggtaccaattgccaaaacagtgaaataaaggaaaggcgtgagaaagaaagataaatgaaattcccaggtattacacaatttacatcaaagtattttctaattggtaatgtaaaatgttatataggaaattttacacatcattttatatatctctttacttgaagtgttaaagtgatttcccatataataattcagaaaattatgtataagctaacaaaacttagacctgtagactctagttgtatgtagaaactgccaatagctgctaattcaattctctcttcaatgtaccccaactgatatcttgtttactgggaatatcacattcttctctctcattggactttatttcactggaaaaataagtcctaaagggaataacaaagaaaactacaattgagaaatagaaacaacaacaacaaaaagtttagctaaataattaaagatatttgatgagcatcctggggatatccaagttaatgaacttgagtgagtaggatgggcattcatctctgattcccacctttcagaagagtgaagaaagcattaaaccatgaaactatggcttgtgaagatttccgagggccagtttactgagtgctgagaatgccagttttttaaggcttctcattaccttttagcatttggaacccaaagtggagaatgattgcttctgaaataacaagaggtcatttcctcttccttcaggtctcttcctaaatgttctcttgttccttatgctgcatgatatgtaagataaaatttatttttttcattgtatcattaaaaataagaatctttctgcaaggaaaaagaagggtatttagataaaaccaggagtttactttgatacttccatgtaaactcctgtttgtatcagcagtggtaccttggctgttgtccagcggtttaattggctcttgtttgcctaatctcctgtaacagataatgttattacagaatcgtaggactccaaaatttcccatcagacaaaacaagccttttaatgagaatcactttgttttacctggcatttggcttggtttgagccacctcaatcccatctcacttgtgagaaatgcattatttttcctaacaaccatgctaattctaagccaggaaacatttttttggatcacttcttttctggaatgattcaaagttcaggaaagtaaaagtgggaaggaatttaaattaagctgagatgggaaggagacataattaaattggactttattacccctgttttgcaactaggttgatgttaattggtatctcaaaagacatagcactataacatttgctgtttttgaatttacattaatttcttctataatagtacgtcagtgtatataatttgtctaaattctgtatcttttatttatccatttagtaattcttacattcaaccaatatttggtgagtgtatttcgtgtttaaggcactgttctagggaccactaatagagtaaagcaaaacaaaccgacaaacacaaaataaagtcctaactgtaatggagctttttgttcaggtagtgaaaattgttttaagaaaaataatatatggggataacagtagaccgtgtatgcaggagtaggacagttatatttatacatctatacacacacacaaatacatgtatgtattcacatccatatacatctgtctacatagatatagattataatgttatattataggatgtcaaaaagaatctctttttgataggctggcttttgagagaattaaaaggaagtgaaggggcaagacatgtagccatatggacaaaaggaaattacagacaggacacagaaagttgcaaaaacctgaagtaaaagaatgttttgtgtttaaggggcaacaaacagtgatgtgagttgggggaatatgctagaagaggagatgagagagacaaggtgggaatggaaaaagtccagtaggacttccgtgacaaatatttaggaatggattttgttaaacaacatgtatacgatattgtggttaaagtagaaaatcaatgatagactggattaagaaaatgtggcacatatacaccatggaatactatgcagccataaaaactgatgagttcatgtcctttgtagggacatggatgaaattggaaatcatcattctcagtaaactatcgcaagaacaaaaaaccaaacaccgcgtgttctcactcataagtgggaattgaacaatgagaacacgtggacacaggaaggggaacatcacactctggggactgttgtggggtaaggggaggggggagggatagctttaggagatatacctaatgctagatgacgagttagtgggtgcagcacaccagcatggcacatgtatacatatgtaactaacctgcacattgtgcacatgtaccctaaaacttaaagtacaataatagtaaaagaaaaaagaaaaaaaaaaagaaaatcagggccatagagaaaagatggaagcaaatatagtgtagagaaagctaatatgtttctgtagttgatcactagatttctctatcagtttcctagtggccagggcatacagggaaataaaaatgttgtatgtctggttaaatacatttttttaaagcaagcaagtataccaattatttagggaaattgaaacaaaattacaaaacaattgttgctcttgtttgtcttctttgttagccaaaaaatgcctcccctttatttttatttgttgttgttttggttcttcagtttctattaaataaatttccacacttgagacgctgtgtaatttcatctagttttgtacaaggttgtgggtgatacaatcttatgtcatttttaaattgtccactaccatactgaaattttcatgacttgccttcatatatgagtatgtttttatttcaatcccaagattcaagtatacaaacgcagtgcttttttaataggaagaacatattaaaagtcttcatataccaagagaaaacttacttctcttagaatactgattgtctctttataaccactcttttataagtaattgtataaactcttacattgggattatggtagtttcttattgatctggtaaatgttttctcgtgtctataacaattcaaggtaaaatacactacaatcaccagaaataaactatgttttctggtactaaaatcattattttagtaatttttaaaaataatgttcattattatccattatctgagagatacctctcattacctctctcaaaaatgacaagaaagtgaaataacatgtctaagattattgttacctaatgtttataaaaatagataaacccaagaaaaatatcgaaaagtattaattgtatgaaaagatggagaagaggaaaatatcccttataatgaaaatcagtcatgctagatgataaagtggtgagatttaaacaattttctgggcattgtattctcaaatggatagtgagttgagcaaatagattaaaaatagtgtaaagtaatgcaatagtaaaataaacatgctgagtaggaagagttaagtcttagataacaaaaggcagaagacaaattaaatcaaaataatgtagaggcatgacaatgaaagctaagtagtctatggaaaactgttaagagacctgaattaattaatgatgataatggtcgtaactaacatatatatgtagtgacaggaatcaatccaagtattttacacaaactcctcatttaattggccccacaactcctttaggttggtattattatcatttccatttacacatgacgaaactgagagcacctagaggattaactggatcctaacactcaaaggctttgtgatatgaagtgttcagtgattaatgtgtttgataaggttgaagatttggggtgcatcatttcatatcaactatagtaggtggaccctgtcaggagaccagggaagagatgattagaaaacccagatgaaagaaactaggacctttatcaggaactaaaggtgaaactatacatttagatggtgtaaatgccttaggggacctgaaaaatggcaagcatttaaggtgaaaggtaaataggtgagtagccccaattgaatgtataatattaatgaaagtcacatttaaagatgtttagacataaagcaaatggtcttgttatttagcgggacttaaaaggtaaatcagtaagtggagaaaatctcatctacaatgggaaaatataattgagcttagactggatataaaagggcagaagtggagagctagatctatgtgtatttatccagggtttgttatgagcccagagaaaatgtaggaaaagaaattcaacaactgaaaaagcaaaaaattaaatgaatctgaacaaagaaagctgcttatattagatatattttctggaaaaagatataggtgtcctgtcttagcaaaataggaactagaacaaatgccaccatctttcaaaatttaatattttcttgctacaatttatgtttatgatttatacttatggatatgatactctattaagaggcatcttgtgtgaaacaattatcatatacattgcaaaatagaatatgtataaatgtttccgtgtatatgtgtagatgggtttgtgtgtatgtgagagagagcaaagagggggagggagagagagggaggagaggagaagggagagagagaggcagcaatttctaagtatttctaaacataggagggttataagattatattcatggaaaaaagacatgttccagttcaagctgtatgcatttatacagtggactactagtatgatgaagctggagaacaagtcaaaacactggagtggaagcagaataatcacacacaagacaggtgaaatattccagagtcaccttgaaataaatataaaattgatgttggcagcctgacagtgacaggagtcaagaaatgatgctgctgtgaaatcacaaaagatgcaattgatattttaatctcaaataccacgtctgaggagaaagcctgaaactaggaattgtttgtaaaagtgtatctgttgatagatttctgattttgctgcttttcatttttatcctcttatggagaataataataaaagtagtcacatttttagtttatattgctctttaatttttttcttaaaatgaatttgaatttttttaagacaagaacataatatgctctgaaatcgtgtcattagatttaaaaaacattattggagatatttttcttgttagaccactgcttttcttaagtgaagttgaccttttgagtttttagtaactaaggtatttgtgtgtgtgtgtgtgtgcgtgtgtgtgtgtgtgtgtgtgtgaaattcattatatttgttcttctaaaactattttcttcagttctaggtttcctagtttggagcagaattctatatttttcttgttttatgccctaggaagggcataaaattattttgaatatttttttccctcttcttcctgacccatgtaatcgcctagctgaatcaggcctccccagaaactgattcatggtcgttgaagtatctcatatgacccccatcccacctagtccgatattaaccctataaaatgtctcaaataaactcttattttcgtggcctctaatctccttaattttttaattttagattcagggtgtacatgtacaggtttgttacatgggcatattgcatgatactgaagtttgggcttctaatgatcctgttgccgaagtcctgaacatagtacacaaataggcagttttctaacttttgcttcactcctgtctttcccccttttggaatccccagtgcttattgttcccctctttgtattcatgcgtacccagtgcttagctcccacttttaagtgagaacatgtggtaattggttttctattcctgcattaattcgcttaggtgatggcccccagctgcatccgtgttgctgcaaaggacatgattttgttatttttttatggcaatgtagtattccatggtgtatatgtaccacagtttctttatccagtccactgttgatgggcacctgggttgattccatatctgctatcacgaacagtgctgcaataaacatatgagtgcaggtgtatttttgctagaagaatttattttcctttgggtatatacccagtaatgagattgctgggttgaatagtagttttgtttttggttaactgagaaatctccaaaatgttttcacatcagctaaactaatttccattcccaccaacagcgtataagcattcccttttctctgaaacctcgccaacatttgttattttttgactttttaataatagacattctgactggtgtgagatggtatcttgttgtggttttgatttgcatctgtctgattatctaatctcctttaaaagcttcctacatcttcctgaaaatatatattgcttgattaattaatttatttatttttcccttccctttttcacaaaggattgctggctgcttatactaaaaccacatattattaaataaacaacaacaatgtaaaggacacaaatgatgcaaattaatcatataaaagggacaacaattttgctgtgactatttttcttactgtcatttgagcttcctagcagggaatataaaaggcaagacacagtctccaatgcaggactcaacataagataggaagatatgttaattgctgatttcattaaattttatccagccggttcattctaatgcctctgttttttcaactgtgcaatgaagatcatgcctaccttgtagagctactataagtagtctgatagttcagtgacacatatttcagtgtgctcatcacatttatccaagggtagcttccgagatcaccgtcagtttcacaggaccttatctatataaatgatgatgatgatggtggtgatgataattatggtgattacagttagcacttattggtaacttgtaactgggaagtatggtaagtattttcttggcttacctcatttaatcctgaaaacagctctatacagtgggtacttttaaaatgtgcattttgcattgaggagaccttaggctgagtgacttgatgtccacacatataatatgaatctgctatatgtttatatatatagcatttgaatttgtgtatttgaatttgtaatgataaatatgggagaattaccctgttttcttacctcctctcactactgcaacttattaattggacgaaatatgaaagtaataaattcagaagagacagagagcatttttcaatgttcattatttcagtaaaatataaacagctcacagagatatttgaaaaatagtgagccaaacacattcatttcatttttccttgttcttcttttagaataacaagcctagtatgtctctgaaactttttgcaatctatccggttataatgttagcaccaatgtagccataagtaatttttttttgccaagtttgccctaatgcattatatcatttgagtgcatgggaagatattagcgccattaaaaatattagtaaaactgatttcagttcaacaacctgtacattgaagttgttgcatttatctatttacatctctctgttctgtacaaaagcagcaacttaaacgatgtagataaataatagtgacattttatctccctttctaaagttgaattccagaaggtaggaaagatcctttcatgcttacattaccatgacaaactgaaagagataaatccctaacggatgggatgagatgtgggagttagaggattaatgcttagatgcttcctccaatttatttctcctattatatgtgttaaaaatatataccatatgtcatgcagcatgttttaatcccatcaaaatgtctcacacaattccttaggggatatgctttttgctgccaagttttcaccgctggaatgctgacttactattcctttgcagagagcttcatggtttattttatgataacatgttgttataacttctctggctgtaatttttataaggagaattagtcccgggggaatttattttgagagtcatatgcttaatggtgacagaaaaggagagaaatatttccaaaaagcaatgtatccttcagttgttttaatagaacagaaattcctttgacaacatttgtgaaagcctttattatacccagcatttaaattcagtccttgaaatggggttttcccggatcatttgaaggtcaattttggaatagttcttgtgtcctatgacacctttcaatgatagcactttacagagaggaacaaatttaaggcaaaaagtctcttttagtgatactaagtatacatgacttatagcaggtgacaaaaaagctgcatataattgccctagggagaattttctttgtgccacgttgtcgctttaaaaaaaaatgcatgtagcaaaatttcacatgtaccccataaatatatacaaatataacatatcgaacaatttaaaaaatattgaataacaatgtgagcgattaggtaaagaggacaacttgaactaattttcacgtcacaaaaaaacaaggttaaaactttacaccaggaattaacaacatgttaccttcgggttcctctgtgtgatgttttagtttgaaatctcagtatccttaaagttaccatttgttttatacgacattgttcagctaactcatgtaggctagggcccactctggcccccaggtatatgattttcaccaatcagggatcactacaagatttacttaagtactcaaatataataaagccaaagttattatttagttttttttttttagaaattaagttgctccgaaatgtatgcaccctgtttccaatcaagccttctaattgtaataacattcccccacagaggctctgttagcatttatgggctatattaagaagaaaaaatacacacacatgagcacaattccagagatgccctttgggttttgctttccttattggaagatataacctaaatggatgtcaggtgtgcaaatagactatattttttttgttccataaaatctgctgggcatggttcaaatgctgtcttttaagccctttgatggtacttaataaatgcagggatgcaaactgaggagttacttgacacatcatcatgccattggcagtatattgatggtaaatatgaaataatttgtttctcccctccccaactctaacctcataagtttcacacatatcagaccttagcttctctttgtcagactcaaattggatttccttttctatcatctctaggctcagacttcgatgaccctaatttggcagctcttcaaggggtttatggtgtaagccttttctatttctaacaaaaaacacagctcaaatcctcttcacattagtgaatactgtttgaagtttcattttccaaaagataccatactttcttaactcaatttttaaaattatttttactttttctgtactgaatagttagtacattttaattttgagtgaaaaaaagttggtttgaatagaaagtatgcattaaaattctccataactggatttcgtagtcaaatctaggacagaaataatataaactattttatatactattaaataaatgggatatttatttaagcaactgttatttataatttaggtgctacttctacatttagggatttagtatatactcctgttggccagattttaacagagttcaaatttcttaaatggtgttctctttagcttaaataactatatgtcacaaaaatctgaaaaaaacatataagattaatcatgattttaaaatttaattgatgctggataaatgtaattagaaacaaaatttcaaagttgtattactactagaaattctcatctgatctatatattaaaatatagtcaaatatttaaggttgcctacattacagtgggaaaaggtaaattgaagttgcagcttcttatgacatataacctatacatggtatcatgggtcattttgcttgtttcatttcccattagaggaattttaatgaaggaggccagtaaaatgttgattaataagtgttgatgtgaaatacacttactgggccatataaaagtggcaagcttatgtagactaccccccaccattattatattttttaattctatgagtatggaactccagaagactggaaaccatagcttttatctttttcccatgagagttatttatccagcattttcttcaataattctacaagatataactagagacatagatcctattagtttggtaaacagttataattattacagtagccttccttatttttcacctctttgtcccaattcattcttattaagatttaaatgttggggataatttattttaccaaatgttatagaagacagagaaattaaaagcaaatggctaaagccgacataaggtttcaagagctaactgaggataaaactctaatcgtgcagactttagttgctgtattagtctgttctcatggtgctaataaagacatacccaagacagagtaatttataaaggaaagaagtttaacggactcgcagttccacatggctagggaggcctcacaatcatggcagaaggcaaatgaggagcaaagtcatgtcttacatggcagcacacaaaacagcttgtgctgggaaacgcccatttataaaaccatcagatctcctgagacttattcactaccatgaaaacagtatgagggaaaccgcccctatgattcaattatctccacctggccccgcccttgacacatggggattattacaattcaaggtgagatttgagtggggacacagtcaaaccacaccaatcacgtcggtaagggtgagtcaaatggctagtgttccctcaaaagtgagtgtgctgcaagagggtatatgtgatatatgtatgtgtgcataagcacaatcacaagattaatggattttaataaaagatgaaaaagtattacccagaatactctatcaccccagtttgcttgattgatcaattggcttccggtatcataacttgcattctcatcccacttatatagttaatttttatatttgtaataaaatgtatagacagtaaaaataatatagtaaatatatatattatatataataaatatagtataactgaacgaataaaataataaaatgtatagacagtaaaaataatatagtcaatatatattatatataataaatatagtataactgaataaataaaataatatttttatttccttgcttttatagatattatctccaagaaaatcataggggaaaactttaaactgttattgttggtcagtcacttaatcattaaagtaccctaaactttttttccaacttgaagtcgactttcctaggtatgattttaatggctgcaacacatgccactgcatgattctccattgttgcctttcagattgctgtgattttttttaaaactacaaccaggtacatgcagataatgtcttcaatgttatctgataaataagataatttgtaggcaaaaaataataataacccttcaggctctttataaatgtttttaatctaagtttccaagagacctggaatcaattccatgccttaggctaaattcttaatcttccttggagacatgttcttcctccagacctcctcaatttagtgagtggtaccaaaacccaccctcttgctcaactcaaaaacctggctgcctctttctccctctcccttacccctgctttttgccgttatacgctatcatgtttctttccttctacttccttgcagtggtttccatcacatttagaataaaatccacctttttaaaaaaatataatctacatgctgcccacccctctaacagatcactaactcccaggcacacggagcagacagactctcctgtacatgctgttcatctgtttggaatgttcttctcgcacttgccatgtctggtttctttttgttcttcaggggtcaattttaatgttccatttgcacagaggccttcctagatgacctcaatctgaagtggctatccttcgcttgcataatacctttcctttctttggtgcctttttgcaatgtataatattatttaatatgtttgttggcttacttgtttaaatatctctctttacaactagatatactcatgaaggttgctaccatgtctgttttgtttaccagcatatatgccatgctaatcatgttgcctgacacattgggttatagtggattggactgcttgggtttttgtcctggctctgaaatgtattaactgctgtccttgagtacaaatgtaagatgggcataatgataatacctaccgtgaataaaccaaattattcatatacagttattagcatagtgcttggcacaatatacattctcaatacattgtagttactattattttgttctagtaggcattcttgaaatattttttgaaagagtgaaataatgagtttattttgtgatataaataagtaagtaattacctctttggtatatgagtatgccatttttatcccaatctttattgctttgagtatcatcctttaagttactaataggtagctgggcatggtgactcaccatggtgacccagcattttgggaggccgaggtcggcagatgacctgaggtcgggagtttgagaccagcctgaccaacatggagaaaccaagtctctactaaaaatacaaaattagccaggcatagtggtgcatgccagtaatcctagctactcgggaggctgaagcaggagaatctcttgaacccaagagacggaggttgcagtgagctgagatcgcgccactgaactccagccttggcaacaagagcgaaactccatctcaaaaaaaaaaaaaaagttgctaatatgctaaaaataagaataatgctcatgtttttacttccatacaattgattgttagaggtgaaaccttttcccatctgcacaaatttctggaagacaataaatgtttcttcttctttcattaatattttaactgtggaggtatctgtttcaaaatgtaaaatccaataggtaatcagtgaggaatataacctagattaacttttttttttcaaaataaccaaagcacactcagtttaagtttcatgttaaagtgagccaaatgccagttaccaaaatattggatggctatgtatataatcctttgctgatgagtaatttagcatcaatttagagatgttattttttttctaccagatgctcgaaagcattaaggcaagattagaagtcattgtcccttcttctgttatcagtggtcccacaatatttgtttatatcaccattagaaacaaattgtactgtattatagttatttttttgtttgtccctcctattagagagtgagttcactaagggcagacattatgttttatactttattgatgtggaaagcaggcagtaaagaaagaatgaaggactgattattggacatttgttattaatgatcttagcttattattttcctccaaatgaaaatgttttagtgaacataaactgggaaaacagcaggagcaattcagttaatactcagttaccttgaagaggttgaagcagaaagtgtttgtgtcagttgttttaacataattgccagtaaagatactgaaagtattccctcatgataatgagaaaaatccagaacacaaggcttgattactcctacaatatttgcctgctttgactctgactgtgcttaagtatatccaggcatgctgtgcaaagtacagaactgaaataaaataatccctagtccaatcataggcttacgttactaggataagtcaagtttgtggtttcacctgaagtaagaaagcattaagtcttcttatcacacccaatcatccatattaggcttgggatagaaaaggcactagagacagtagggataagatttagtccagggagtaagtacttggtttcattaaaactaccctagaattggctcaccagtattaattaagtcctttttatttgtaatctcattcatcattctctctctctctctttctctctctctctcccccccccccgctctcatagagcaatgttaaacaatgtacacttctttttttaaagttatagatttctaaatttaaaatgttctgatatagtctagctctccaattagggagaagtagaaacatatgctgctcagcttttctaaaatcttttaaagtaatcaattagcatatgggctaagttcactttagatggatacacacatgcactatatatatatattttctttagacatgttaaggcagtggataaaatttccttttgcaatcctttgctcatggtatattaatgctgatagtattttatgctattttgtgttgatgctctcagcacaaattggccccaaaatattctgtattcaaaagcatgtatttttttcctaagcgtactatgattttaatagaagcagaaatgagtgtttccttcttttgtgaatttttgggagggcatgcttccctgcagtctctggagtgtgtgttgacattttttgtgccatgatttcccataagtaacacactcttttgatagtgaagcagtgagggaaagttgctaagttccatctgtaagaaagcattatcagaagtggaagaagggaaatttactaagttccatctgtaagaaagcattatcagaagtggaagaagggaagtgacaagaaaagattcaaagttgttttgttttagctccagtagatgctttataacacactcctaaaaagagtgtgaatataatatagttaatataaaatttattttatataaataatttataatcttcaaatataaatttgtttttactatataagcaatgtaacattgacctaaaaattgaattgaaaaaatataaactttcttctcagaaactgggttctcaattactctctatgtacctgtttataaaatacaaaccatctagataatcattgcaccacaatttgtatcaaactctgtttcttagccatcctagagtacaatcaatatcattgatcttttcgaaaaaccagcttttggtttcattaattttctttattgtagagttctgtttctttaatttttttattattatttttgagaccgagttttcctcttattgcccaggctggagtgcagtggcgctatctgggctcactgcaacctccgcctcccgggttcaagcgattctcgtgccccagcttcccgagtagctgggattgcaggcatacgccacgacacccagctaattttttgtattttagaagagtcggaatttcaccatgttggtcaggctggtctcgaactcctggcctcaggtgatccgcccacctcggcctcccaaagtgctgggattacaggcatgagccaccacgcctggccctgtttctttaatttttagataaggatctacctttaacttatgaatataatatataatatgaattatgaatattatgaatataatatgaattatgaatattatgaatataatatgaatggcattgttgtagggtgataactattttaattcaccttcttgaaatagataacatttggcttttggttagattttagatttatctgttaatgttcagaaaaagataaaagataaatcatggaatctttttttttatttttttattttattattattatactttaagttttatggtacatgtgcacaatgtgcaggttagttacatatgtatacatgtgccatgctggtgtgctgcacccattaacttgtcatttagcattaggtatatctcctaatgctatccctcccccctccccccaccccacaacagtccccagagtgtgatgttccccttcctgtgtccacgtgttctcattgttcaattcccacctatgagtgagaatatgcggtgtttggttttttgttcttgcgatagtttactgagaatgatgatttccagtttcatccatgtccccacaaaggacatgaactcatcattttttatggctgcacagtattccatggtgtatatgtgccaccatccatggtgtaaaaatgctcaccatcactggccatcagagaaatgcaaatcaaaaccacaatgagatactatctcacaccagttagaatggcagtcattaaaaagtcaggaaacaacaggtgctggagaggatgtggagaaataggaacacttttacactgttggtgggactgtaaactagttcaacccttgtggaggtcagtgtggcgattcctcagggatctagaactagaaataccatttgacccagccatcccattactgggtatatacccaaaggactataaatcatgctgctataaagacacatgcacacgtatatttattgcggcactattcacaatagcaaagacttggaaccaacccaaatgtccaacaatgatagactggattaagaaaatatggtgcaaatcatggaatctttaaaaaagaaattttattcctgtgttaatgtgtagttttaaagatttgtttaacagtgtgtactaatgaagcataatagataccaaaatgttttcattaggaacaaaggtcaattgtgcgagaaggagtcaccatttatgacctgacaggttgaggtaatgcaggcagggtaagacaatacatgagtaagcaagcccccctcccaacagtagtcatcattaataggaactcactgcatttagggttaacagatatatgatgggtttgaaaattaccaaagtggaacccagatggatatgtagatttcagtatcattatatacttggaaattgaggaaatagtgtagaaaaatacataaactggaaaaaatcttatcagtcaagaattaagttctagggacttgctttgacctctcattcattcctttatggcctcttaatttctctactttttctaagcttctctctgcatatatcttcactcttatctccctaagactagctttctctacttattcataggttcctccttatcactttagattacatgtggtcatcacaacttctttggccctaagtctaccttaagccttttgtttatactcagaaaggaggactctgattgggctagctcatcttttctaatgaaaccaagagataggttacttgcctgcataggacttggctgcccttggttaaggggccatcatagcaccaatcagtcatgtctggtctggccatggggatgcataaataaacaaatggtcttacctttccaacctcttcctcaatcactacctaccctaggaccacaaactctatgttctatccaaaccactcttttccacagatacctaatcatttcactattcacagtgttaacctgccttttctcacttcttgaaatttccatcacagaatgcatgattaatctcaaagcctcatcccttgcatgtccccatgaagtactcttttactttcctaggaaaagttaacactctgatagtgctttgtttatgattgaataaggtcacttctggtattgtatttccactatgagagtgatgtacatgaactattgaatataaaaacatacctttgataccattttgttgtatagtttataaaagaaagctatgacaccatagggttattaacattatattacttaaagtagtggtaaaaacaacacacatatacacacacaaacacatacacatacatagcacagccagacttggcattctaacatccccacacatgagaactatcaaagtatcatttctgagctgcgttgtttttctacttgtgccctatttctaatagtggaagaatttttttttaaagcaaagctgttatcttttaaacactggaataaaaaaaaaattccattttctgcatgagtcagttttttcagtgaatattttcagcaaatgaacaagctctgcattaaatccatgctttgttttagtagtttccttgggtggactagtttcaccgaatgccatgtgtaaattggtcacatagaacaagaatttatatttccacaattttatttggaactttgaaacttccattatctcacagaacccagaaattgaattgaggctttgttactaagccaggttgtagcaacagacttaggagtcagtagctcaattttctacttctttgcatcaaattttctcctgagaatgatgcatgcaatacagaggaatggcagggaggagcctctgtgaagtgttaaatgtttggttcactgggtcctatcagcaggtagggcctgtggggagcttgtttatccagcagaacaatctcattatgaggacagtgatgtacaatagtttgcttcataccccaaaaccattcaaggaaacgactgagtgaatgatatttttccgggccctgtattatgctattatgacttgcaataactggcagcatattaaaacagaagtcagggactacagttactctgttgaatgaagttctgaaatttcaaaggtgttgattattcagtattttccaatttacagaataaaagagtatgtgattgactatttcatggcgcagtaatggaaataaagaaagagaatgaacaggcttgattaatttcagagtaaatgcttatttttcataattgcataattctcaagtgggtctctgtgtagaccggggtggccttttctgtcaaatacaaagataagaacttggcattgaaaattaaggaacaataaaaaataaatatgtgtgcatgtgtatatatgtgtgcgtgcacatacccttgtcatcactaagggcaagccaccacacagccttggttagctttgaaaatatctatgaatactacattgaaaaaataaagtaagatttgggacaaacatccatcttcctcatgacaatatgctgggaacagctgtaagcttagaataaagtggggaaccctgcttaatgcgctatgcagtaagcttatcaaatctcagcccagctagaacagtgccctaggatacaacaggcaccttgtaaatatctgttgaaataaaggatgaatcagtgaacgaatcaatgaatgcttctgtccagaagtgacacagactaaatgctgtaaaatcattcatcctctaaaatttcaaatattgttggttgtctgaaacatattaaaggaaagggacatggtatgaccactaagtgtctgaagtcttaacttttgaaggatgcatcaagaaacccagctacatcttttcggtagaaagtagctaaagaaaggattctgaattggatgaaccatgaagtcctaagttcctctttaaagctatttattaaccatacaaaaacatactttcactcactgagaatttaaacttttatttaaatattagtgatttactgcattaagtgttatcatgagatagcatctgctaggccagaaaattcatctagttttgagtttaatcgttgttaatatgcagactgtaaagataatctcactggtaaaccagtgataaaccagcacttgatgatcttttaattgctaagtagcactgaggcagcttacatttggctttggatttagtagatatttatattaacaactggccagtacagcttttcacgtaagtacttcacctcaaatttatcaatcctttaaaatatacatgaatttaccccacacccataagctgcactctcaaagataggggaaaataaaaccaaaagcaacaaagattgaatcaatgtaattttctgctgtttaaacataggtttctacttaccttgattatttaaagaatgcctgaaatcatgccaatgaaaactctggaaagtagagtttaaggttcaaggcaaccttctttttttttttttttctgtgctgccatcatctctcacctgaactattgcagtgatcttctaataggtcttctttttgatgtctgtcacctacattctattgtcaaccaagcaggcagagagcctattcttaacagctttattgaggtataattgatatacaattaatcacatatatttaaagtgagcgatttggtatgttttgacatatatataaactcatgaaactatcatcaccacaatcaagactgtgaacatacccatcacactaaaagtttcctcatggccttttgtaatgctctctccctttcgtcactatcccagacaatcactgactcgctttctgccactatagtttgcattttctagagttttatataaatggaatcaaaacagtatgtactctgttttgtctgacttttttcacttggtgtaattattttgagattcatccatgacatgtataaataattcattcatttttaactagtatttaattatatgactacattcatcatttgcttattcacctgttggtaaaatttacattgtttacaatttggagctactctgaataaggcttctatgaacagttgtgtgcacgtgtatagacgtagagttttcttgtcttagtcaaatacctaggaatggagcagctagatgacgtgaagttagtccatttgttcttttatgagttatgcttttggtgtcttatctaagaaacctttgcctaatccaaagtcacaaagattctctcctgtcttttctaaaagttttatggttttatgctttacatttggatccatgatcctttttaggaaaatttttgtttacagtagaatgtatgaatcaaagtttagattttgtcatatgggtacccaaatactccagcaccatttgtctaaaagagtatcttgtctgcactgaattgcctttttgctttgttgaaaatcagtggcaaatatatgtgtggatctatttctggactctaattttgttacatttatctatttttctatcttgatgacaagactttgattatgtttgattagtttgattatggtaactgtgataaatcttgaaatcaggtagcataagacttcacgctttgttctttgaaaaagttattttgaatatagcaggtacttaacattttcatgtgaattttagaattagtatgcccatttgattgtcattgtattaaatctatataacattttggagataattgactaattttttttaaacttctgttttacattcagggttacatgtgcagctttgttatataggtaaattgcgtgtcatgggagtttgctatacaggttatttcatcaccaaagtaataagcatagtagctgataggtagtttttcaatgttcacactcctcccaccctccaccctcaagtagaccttgttatctgttgttctattctttgtatccatgtatacttcatgtttagctcccactttataagtgagaacaggcagtatttggttttctgttcctgcattagtttgcttaggatgatgacctccagcttcattgatgttgctgcaaaggacatgatctcactcttctttacggctgtgtagtattccatgatgtatatgtaccacattttctttatccagtctaccattggtgggcatgtaggttgattctatgtctttgttattgtgaatagtgctgcgatgaacatatgcatacatgtgtctttatgacagaacgatttatattcctttggatatatacccgataatgggattgctggatcaaatgatagttctgctttaaattctttgagaaatcaccacactgctttccacagtagctgaactaatttaccttcccaccagatgtgtataagcattcccttttctccacaactttgccagcatcttttgttttttaacttttaaataataaccattctgactggtgtgaaataatatctcattgtggttttgatttgtatttctctaaggattagtaatgttgagcattttttcatgtgcttgttggctgtgtgtatgtcttcttttgaagagtgtctgttcatgtcctttgcccagttttgaatgctgttgtttgttttttgcttgttaatttgtttaggttctatatagattctggatattacacctttgttggatgcacagtttgcaaatactttctcccattctgtgtgttgtatgtttactctcttgatagtttggtttttgctttttgttttttatttttatttatttatatatttttgccgtgcagaagctctttagtttaattaggtcccatttgtttacttttgcttttgttgcatttgcttttggtgtccttattatgtaatctttgctagggcctatttccagaatggaatgtcctagattatcttccagagtttttatacttttaggcgttacatttaagtctttaattcagcttgagttaatttttgtacatggtgtaaggaaggggtccggttcaatattctgcatattgaaaccagttatttcagtaccatttattgaatagggagtcttttccccattgcttggttttgtcaactttctcaaagatcggatggttgtaggtgtgtggcattatttctagactctattctgttccattggtctgtgtgtctgtttttgtaccagtgccatgctgttttggttactgtagccttgtagtcaggctttattactggttcaatttcagaactcactatggttctgttctgttattgttctgttcaaaaatatggtttctccctggttcaatcacttataaaggcttggtttggctggatatgagattctttgttagaattttttttttaacaattctgaatataggcccccaatctcttctggcttgtagggtttttgctgaaaggtctactgttagcctcacggggttcctttgtaggtgacctgccccttctctctagctgcctttaacattctttcttttatttcaaccttggagaatctgataactatgtgttttggggatggtcgttttgtacagtattgttgcagaggttctctgcatttcctgagcttgaatgctggcctattagcaaggttagggaaactttcatggatgatgtcctcaaatatgatttttctttctgtctttcggggatgccagtgagtcatagatttggtctctttacataattccatatttcttggaggttttgttcattcttctttattcttttttctttatttttgtctgattgacttaattcagataaccagtcttcaagctctttgctcagcttggtctattctgctgttaatacttgtgattgtattatgaaattcttgaagtgaattttttcagctctatctgatcagtttggttctttcttaacatgtctattttgccttccagctcctgtgtctttttattgtattccttagatcccttggtttgggtttcaactttctcctgaatctccataattttcattcctatttatattctgaattacatgtctgtcatttcagccatttcagcctagttaaaaaccattgctggggaactagcacagttgtttggaggtaagaaaacagtctggctctttcagttgccagagatcttgccctggttctttctcatctgtgtgggttgacgttccttcagtctttgaagttgcgtcctttgaatggcactttttgcttttatcttctgtgatgccagtgggggtttgtttgtggtataaggtgggtttcaactggcctcttttctggaagattttagggggccacggctcaacacagcactcctggactgtgtgttctaactctgagggacttttaccgggcccctgcctttgctctcgagccccttgaagttaagatcttgctgtactggagggacctaagtgttcttggtccactggccacaacacgctgttggagagtgccagccaaagcgctttgtccagtggtagcagtgggatctgtgctcactcgggtgtgccagcagccacagcatgtgtggtagggtgcacatttttcagctgaggaggggcaccagtgggggcagggttgctgtcatctgtgctagcatttgcacctgcagtggtgggagtagggcacttgcagaggcagggtttcctgtgcccatacacagattcacaccggtggtggcagaagcagggttggtagcatccatgcgtgtattcgcactggcaggagtgggggcatggtgggggtggggttgccagtgcccatcaaggcaatcttctatacttgaatttgttaatcatttcacaatacatatatatgtatcttaaaacaaaacatcacattgtatgccttaaacatatacaatttttatttgtaaattatgcctcaatacagctggaaaaaaaacacatgcaaagttacataaatatccccatgattttttcctcaagttatcaccccttttttcttacttgagtctgagagtgtttatgaaaatgctatgaaaatgaagaagtactaaaccgataacatggatggatattattatatgtatgacaaaaatgagaaggaaaggtcctgaaggaggtacacagatacatttttgtaataccctgaacaaaatgcagtatgtcaacagataccaatcataatagatatatgattacacatatgaatgtagattaatgcccaaaacagttgtatgtgaagctaatctgtttacaatatattatatatttcatgagacttctctgataaaaatagacttggcatcacttaaaaaatggttctaacctttttaaaagttctcacttagaaattcacttggcggagcagtacacaagctgtgtgtgtctaattttcctctacaatctctgtaagaagttaatcaaataggcaattaatctgtatgatattattcatgtgaaagcatatgcatattaaaatacacaacagacttcattcttattttccttaaatttttctctaatgccaggggcttgaatgtccagcagagctcacaatatgaaaaggatacatggcagtgcttttgttgcacataccagaaagtacaagcaataacgttctgctgtataaacacctgtaatgaaggcagaaaatgtgtagtaagctaacaaacaagactttgaccccaacaacacttatctctcgccttgaatctgcttttgctcctcatttccattaatagtgccacaatcttctctggaatcctgatttgaaatctcagagtcatcctagactccttctcctccttcatctcgcccttctgatcaatttcagcatcctgttgattctgactacaattcttcccacatttccttgtcatatcctttgctacttcttttttttttttgtaacctctattttaagaactttctgagttgtctccttactcctagctatccccttccaatccatccttgatattgtcctgaaagtgatatttctaaaatgtgaatcagataataacacttcgtttgcagacatttaccactgtcaacattggttttagcagtgggtttcaaagtgtcatccctggaccagcagcatcacctgctttgtagtaactactttgtagtaacgcagatccttaggtcccaatccagaccttctgaatctgaaactctgagaggggagcacaaaactctgtgttttaaaaagtcctccaggtgattctgatgcacacgaaaacttgaaaactacggggctacagaattaagttcaagttttttggcatggtgtcttgccaaacctgtcttttctgcacttattttcacctccttacactcttctgtactcctcaccactccactatttcagaaccttaccatatactgtcctattaactgggataaaccattggcttgcaattttctcttccaaattatcaggttttgaacgaagcacatttttaatttcatctctttcttaaatcctttttgatcttcctagacatatttcctgctccattatttcatctgtgaaatggaaaacagttctgggttgagaggtaaaacaaacttcttgctttgtgtttcctcagtaatgttatctttgctctcagaatttattcgtttttcttgtgctatacatggtttttgacaagtctgttcccacttatagatgatatcttcaagggtgatgcaagtctcagtaatctttgtcatagaagagtgagttgcacatcatatgcggtctataacatgttgtctcacaccaatatatgacttgaactttaatgcatgattattttatatgttcattgctgaaaacaatccattagtccatttgggattgttataaaatttaaagaccttttgtaacttactatcttgaaaagtgtaattctgttcttttgtctgctctaaaacaaaaacaaaataaaagtaaatctgtgccttgaaccctgttactttctctttaaaggatcaatttgctggctgggtgtcctgccatctaacaggccttccctgtgaggctcctctaaattgggaaaaggattaaattttatcagtgtttgtttggtctgttgctcatcatgttgatatttaatccagtgtccaacaagtgtcccaaaggaataaaatgcctgaagctggcaatactttttgacctatctgtctgaacatattcctatcagtttttacccaaatagagggttttccaggagacatacatgagctaaataaacaatataatagtaagcttaattcagtaaactatgtttaatatatcaacaaggatttattgagttctgaagtacactcaattttgtgaaatcaaattattctgagttagaaaattgtatcactttgcaatattataaaggaaaaatgcatactgctattttttaattatcagggttaaaaatatctacaaacaatagttataagcgattgtgttaacaccaaagatatacattttcaatactcatttaagtgaacagttatttagttaatcactaatttattcaacacacatttattgattgcctattgtgccccaaatatatatagatatggaaatagctctaaatttataattagagctaaatgaggtttttttttcttttttaaagatagggtcttgctatgttgcccagacgagactagaactcctgggcttaaagaatcctcccacatcagccttttgagtagctgggactacaggcacatgctgctgggtccagtttgagatttagatatgtagatgatagatacatagatagataaacagatagctaggcagatatagaaatagagataaagatagagaaagatagagatagatatagagatggcgatagagatacggtaaagtcccacttctcagagtacaccacacttcagtgatcaatgaaatacatgtaagcaaataatgatttaatatgatacatgctaatgaaagtatgtattaactaaagaacatagggtaactaaatagtcaaaagaatgaaaaaagtcttcaaagtcaaagatggaccatatgtaccaagattttacctatctgcatcagtttcttatgcgaaggctaataaaagaaaataagaatccagattttcttgtaggatgacgtgcatctgtttgtgtttgctgaaatagcagggctttttctgctcctgttcagtgtgggaatggaaagcagaacatcccctgtgttccatgtactgtgttaggtactttctcatgtcacttctaaacactaagagaagtaaaaaaagaagattcaaaaacaagtcttaagctgaatttacttaatgcaaggcaggaataacatgatcccacacagatgcatgggaccttcagattaacagttaaagaattgttcagagaaaattaacctaaaacattgaggatttgttcacatatagacacatacaaggaagagcaacccttatgaagactttttctcaggccgaagtcaagtgtagagctttaaaaaggcaaacttagaagtttgggtttgtttgtttgtttctccaacaacaagagttgctgctgcaaagtgagagtcgctctccctactttttagttattattccaagatatctatccaagtagacacaggttgagtatcctttttttctgaaatgcttgggaccagaagtgttttggatatcagatctttttcaaattttagaatacttgcatatacagtatataatgagatatcttggaaatgggacccaagtctgaacataaaattgatttatgtttcatatatagcttatacacatagcctgaaggtaattttatattttccttggggatgctaaataaattgtgttctgtgaatctacattttgactgtaacccatcacctgaggtcaggtgtagaattttccatttgtggcatcatgttggctggcactcaaaaagttttgaattttggagcattttgggtttcggattttctgattagggatgctcaactttactttaaagtaacataatttatccttctataaatatagtattttgttttcatattagtatgcaacatgtataaattatatcattagacttttttgaaagaattcaaacttcaagtttgttaccatgaacatatttttagcttttacataggtagtaacagtgacttaattaaaaatactttttctactcttatttgaatatattgataatagccaatatatgtagttttcttcatagtacatcagtagtgaaggaattacttctgaatcttaattccattactgtcttcatatatgctcccagaactttatgagaggtaacaaaaatgaatgaatatggtacttcttactcccactccccaatgtaacttcatggcttccttcataaactcccattggctgtgaaagaacgtgtactgcagagatatgttgaactggagtatttccatagaatcctcccatcagggaaggagagtaccaatagcaaattttctgagagagacttacagaagggtattttattccgaaagggagaaaaacagattaagtactaccagcatccacaattacctgatgataattttaaaaaacaataacaataaaagttatatgaattacatacaattaatgtgtactgaaatcaacagtgtctagaaatatgcttttggaatgattgttcccaagccaacaaagcttgtgtgctgaagtaagaaaaaactgaatggatcaacagcaattctgttcatcaagagttagattttaagttatcacatatccttttaagatttgaaaagtctcactacacaaggttaaaaaatatactttgtggctatatttttaaagtctttattcacaaggggatacatactgacgtatttggggatgaaatatcattatgtctctaatttcttttcagctggtttagaaacaataatacaatatagaaggtgtgagagagaacatgtgtgcagatgaggcaaaccgttaacaaaggaaaaaaatatatctccttcatcacttctttcatttagtaaaatgttttattgtaactattgaagagagacataggtccatcatttgtttaaatgattttatgcaggccgggcttggtggctcactcctgtaatcccagcactttgggagaccaaggtgggcagatccgagatcaggagtttgatgccagtctgaccaacatggtgaaaccacgtctctactaaaaatacaaaaattagctgggcatggtggcgtgcgcctgtagtcccagctagtcaggaggctgaggcaggagaatcgcttgaacctgggaggcggaggttgcagtgagccaagatcgtgcctctgcactccagcctgggcgacagagcaagactccatctcaaaaaaaaaaaaaagattttattcaaataatttgaatatgccttgaactgttctttatagtgtttaccatcttttcccaggaattattgaaccattttaagtttattttttaacaggatgcatttagtttaatggtagtaaaacctcctaagccatagatcctccctctgtttccatattgaaatgaacaccaagtgtctctaatgtcgtccaaagtgccatttcttcattttgcctctaacttttctttggcacatgacgttgaactgtatgaaacttttttcctgactgatatttaggtatggaataagagtaattttcaggaatatttgtgattttcttccaacattttctcagaaagcatattctgaaagtgtgtagtaatatctatatgcattcccaacacaactctctctctattctcttgatctaatttgttactaactttttaaaactttctagactaaatctttttgcttaccttcaagcattttgttttatactacaaatcttctgagactcgaataattttatcttactgtttatatactgctaacttgaaggtatttcagcctttttcactagcagcgataccctccatgacagatagtcagttatattaacttgattctattgtaatttacatagtggtaaaacaaaataattttacacttataatcaaaattataactgtttaaaaaattaccacctaggattcattttatgtaatgggaaaatatacaaaactgttttgataaatattatatgcaattatataacttggacatctctgtgtagttttttcctcctgtttaacgtggtatgccagctctacagtagtcatgacaggaattatgacaatgactcagacattgatggtgcccaccaagcttccagcatatttactctagatagtacctcaatacagcccttttgtaaaaattttaaacccaaatttggtaattgaaatgaactaaatcaaagaatgctgtgaaattgacacctttattaaaaaacaatatgtgacagtagggagaattaattctaggttcagataaagctgggtgagaaccccagcactcacccttattagctggcatggagtttcttcaactgtataatttggtaattcagttgtttattttgcttatttattcatgcattcattcatttattcatttagtaaatgtatgctgagctggttagcaggcacaattctaggcactgtggctaaaaagggaagtgagaaggacaaagtccctgctctcaaggggtttacattcaaccggggagacagaaagcaaagtggatgcataatataacatcaaatagcaataggtcttgtgaaaaaaataccaaggcatactctggatcaagtgaccaggatgggaaggcaaaaggcctctctgaggaggtgatatttggcaagaaagaaagagaaagccatgcagatggttggcgaaaaatgttccaggcagagggaagagcaagttcaaatgcctcagtttatatttctgtgaatagtaaatgaaagtttatagactcctggcacatcgttaagtgcttattagatgttagatataattttaagataataaatgtggataattaattccacgttattatgtgtcttctttgctgtaatgtacatcctccttttcatctagaccatttttcttctcttgaatattatattatttatcctgttctcagagctgttagattgccctcttattaatttgtagtgactttaaccctgcttgcaatattcaaatgttattactgtcagaggtcctgttttctcagtctttgcccttttgctcaacatttgtatactctgagtaatgccaaattgattttcttgctaagtgttgggcaactgccctctctaaacagtaaaattcacaacttctctgtgatgatgataatgttgatgtacctgccctatggggacctgttgttttgtatgcatgtgcagggagaggggtgatcaaaaaatggtgtcaagatgtcatttggaagatggtacctgcagaaaacacagaaaacccaatcataccccacccccatcctccgcatttcccaccatggtttcttgtttacacttctccgattctcccagaagtcagagcaaagtgactgtttacctctgtctctggctgggaaaaaaccactcccagagctcaactcacttttattgatttctatattgtttggctgtaaaacatttattctcagttgtatcagtttgggtccagttagagaaaaaaacacagtcatttgaacagtgaaagtttttacaaataattattaaatgtaacaggggattatagtaatgaagggattggctagcataaaagaaagatgtattagtttgctcaggctgccgtaacaaaatactatagactgagtggcttaaacaaaagatatttctttctcacagttctagtgactgggaagtccaagatcaaggtaccagccaatttggtttctggcttttggatggctaccttcttgctctgtgctcacatgatctcttttttgtaatcacgatggagagaaagagcaagctctctggtgtctcttcttataagggcactaatcccatcaagagcctcgttctcatgaccctcctcatctaaccctaattacctcccaaagaaaggcctcatctccacgtactgtcatattgagggttaaggcgtcaacatatggattttcaggggagggcacaaacattcagtctatagcaaaagagaaccataaataatagaggaatggctaccattagccctagggctgagatagcacacctgagaaaaagtccctatgttttcatccccaaagcagagatccgcactttattgggaaggtacaaccatagcttaccgaatggcagaaatcgctaagttgctataccagcagaacttgtcagaaatctgtcttcttcaagttaacagagaccctccctctaaggtacctgggaaacatcgccaagctgctggttgccaagcactgtaggagccaggtgctgaagaaggcttgcacgctgtaagagcctgccaagtgagcacattgaaaataggaagcaaatccctttcttcctgaaatgtctcaccagtgccctctccccacaaagcttcagtgccagctagttaagaaaaacatatctcaaaggcccagatctatttttaccgagcaggcagaaaggtacatttagaactaagaggcaataaatcaataaccagcacactgatataaacaaataataaataacagcagaagcagactcagtgaagaatatattgtttgttagcagagtccactactttgcagggccattctcagtttgattcattgctatgtgctctgtgcctagaataaaatctgacccaatatggatgctcagtaaatatttgttggatgaatgaataatctaattgcttattttttttgcctctaatgtttttcctctctttctctgtctctttttttacgatagccgatggatgcactgactggtctatcgatatcaagaaatatcaagttttggtgggagagcctgttcgaatcaaatgtgcactcttttatggttatatcagaacaaattactcccttgcccaaagtgctggactcagtttgatgtggtacaaaagttctggtcctggagactttgaagagccaatagcctttgacggaagtagaatgagcaaagaagaagactccatttggttccggccaacattgctacaggacagtggtctctacgcctgtgtcatcaggtatccctttaattctattactgctgaatcaaagaaagcacaggctgctttctcgtacttaaatgttgctgctatctcttttgcctaaagccgttgtctcaatatttgcatgtgttgctgctttctaaaatttagaatcaaaatcataaaaagatgggattggaatttatattagacattatttctagcttatggagaaaagcgataccatctgggtagctacttatgttaccaagaattactaaaaactatgaaataaaatttatacaggaagtaaaatggtgcaaataaaatgtaagcaaagacttgcagaaaggatgcatagtttcttgctaaatgagttgtaacattttgctattgcccttcgcagacagatagagcatggatacttctggttcacacacatttgcaaagatgatttaggtaatgtgtgtatgtgcacagggagaggaagagagaattaccatgttagagaatatgaaggttgtgttccagattgctttgctaaccaaaacttctgggtcaatacaaaaatcttcccaagtctttcagggccaataccaaagttaataacaaattcagttcctgtatccccaaggatacccaccatacatctacacatctttgtcagcttctggaagaggtatatgcagtttgtttaaagataatgcattgaagcaatgcccatgtaacacattcgcagttaaaaacctcagtttaagcatttagcccctcatagattgtgaatcacatccttcatgaatgatcatgtatgtcattggactattagaacattagcgaagctgggtatagtcatatagagggtgtgtttaaatctatttatttggctttctgtatttgggcttattcagagaaataaagaagaatctaaagtaatggattcccataactcagagaaagtctcagaatcacctagtgtctttttcaaataaaaatttaccgctcctgaaatcctgatcagcagctaacactcctctgtcataaatatcatgcctccctctcaccgtcatctctaataattacctgtaagctgagccatggctacgggtgtgctaggacattgaaataggtcaagttgcataaaagttaaacagaaaggtatctttctaacactagcaacatatattatgttagagttaatgttggaaaatataaatgaatataagtaaagagttgtgcttgggaaaaatgcctaagggattttcaaagaacaaatgcatctggccgggcatggtggctcacgcctgtaatcccagaactttgggaggccgaggcaggcagatcactttaggcgaggagttcgagaccggcctggccaacatggcaaaaccccatctctactaaaaatacaaaaaaattagccgaggatggtggcacgtgcctgtgatcccagctacttgggaggctgaggcaaaagaatcgcttgaacccaggaggcggaggttgcagtgagccaagatcacaccactgtactccagcctgggcaacagagcgagactctgtctcaaaaataaataaataagcaaacaaatgcatcattcctttggcaactcttcttctttctcttagggtttactaatccttttatgattaaacataactcttaataaaagtagaggttttgtaggggtacagatcaataactgtcacactagtacagttaaagaatactgtttggactagctgttcccatttgaccaatagtaattagattttaatttcatatctgctgtgtttctttttaaaaatcattatttctgattgttcatgcatgtcgtaaggtgattcttcaagataggcaaatgtgtgtcctcatttatctgacattagaattgagttggatgtccatagtataatactacatttcgtcacttattattgatggaaaaataatgatgtgttcacattagtaatctgaattttgaaaacactgaggttgcaattctctgatgtatttaaatatacactgtgatccaatactctgagaaactgcattaaaatgcctctggaagggctgggcaccgtggctcatgcctgtaatcccagcactttgggaggccgaggtgggcagatcacctgaggttgggagttcgagaccagcctgaccaacatggagacaccccatctctcctaaaaatacaaaattagccgggcatgatggtgcatgcctgtaatcccagctactcgggaggctgaggcaggagaatcacttgaacccatgaggcagaggttgcagtgagccgagatcgcgccattgcactggcaacaagagccaaactccgtctcaaaaaaaaaaaaaaaaaaaaaaaaaaaaaaaagcctctgaattaccagttgcaataatgaatgaaagattgaaaagtttccaaaatgatgacacttgccatatgttcatatgtctacattttaataaaaggtgaaactaaaagacaaatactttaaagtttatgtgtgtcaagtggcaatctagagaaagggataaactgcaggaagagatacttttgtcactgaaattcaaatatgccaatcaatttgaagggagtgttgttacagctttcttttccaatttggaaaggggtactcaaaagtctttacaaacagcatttgaaatagcacggcttggtgttgacgtgagaggagctcaagggctgtcagttgagtcactgacattttggcatattgttagctatcaggccactaaactgtcaccattagtttttaaataatccacttgcaaagaattttagaggcttgaaaatgttagcatccattctaaggttctagtctttctgataaatattctgagtattaacttgtcaatgaaattgtttatcaagcttttcatatacaactaatttccatttacacttaaatatatgcaattaaatggcatacataatggaaacacctaagactcctatcattataatgaacaagaactttcttatttccttctttaatatctattttggacagaataataccacacaattctttgctccatacttactggctctttactcagtttactcattcttaaatttatattttattttttacatgaaaaagtgaatgaaggaaagctatgtaacaatttcttttgtcttattttatggccatatataaaaacaagtttactcttaaaaaaataaaaatttggtggccaggtgtggtggctcacacctgtaatcccagcactttgggaggcagaggcaggtggattgcttgaggccaggagtccaagaccagcctgcgtaacacagtgagaccccgtgtctacaaaaatgaaactgtttaaaaattagcctggtgtggtggtgtgcacctatagtcctagctactcaggaggataaggtgggaggatttcttgaggccaggagtttgaggctgcagtgagctatgatcacaccactgcacttctgcctgggcaacagagcaagaccttgtctcttaaaaatgaaatgaaataaaataaaataatagttccgtattcttgacctccaactttttaattccccttttcatagttatgccctattagcagtttcatatgcaaagctagctggtatatgtggaagcattccagtgccccccaaatggtagcatgctaagttatttggcaccctatttttaattaaaattttatttttgagataattgcaggttcatattcagttgcaagacataacgtagagagatgccatacccagatttgctcggtggtagcattttgtaaaactgtggtacaatatcataatcgggatattgacattgatacagtcaagatacaaaacaatgccatcacgtctcaagggcccctcctattgttcttttatagctacatccatctctacccaaccccaatcccaaacccctgtcaaccactaatctattctttatatttatagttttgttaatttattaatgcaatattaatgaaatcatacagtatagaaccttatggaattggatttttcactcagcataattcctttgaaatccatccaagttgttgtacatatccatagttcattcctttttattgctgtgtagtattccatggtatggactaccaccatatttattcacttgttgaagggtgtctctattatttccagtttggggatattaaaaaggaaacttctatgaacattcatattcaatttttggtgaacataagtttatttttctggaataaatgcgcaagagtgaacatggattgaatggtagttgtgtgcttagttttatgagaaagaaccaaactatttttcaaagtagctatagcatctgatgttcccaccagcaatgtatgatttctccacatccttgcagcatttgcgattgtcactacttttaattgtagccattctggtaggcatattgtgataactcattatgattttcatttgcattttcctaatggctaatgattaaaattttcatgtgttgatttgccatctctcttcttgtcagtaaaatgtccatatttttgtacattttataattgaattatttatgtcctcctcattgaattttgagaattctttgtatgttctaaatattaattctttttggagatgtagtttgccaatattttctgactgcctgtaggttatctttttgtccttctaacagggtcttttgcaaagcagaagtttttaattatgataagtttcaatttgtgaatttttccagttatggaccatgcttttggtgtgaagtctaaaaattctgccaagtgctaagtcctgaagatttttccttgttttattttttatttttaagatttaaaaaattgttaaaaattcagttgctttacattttacatttaagtctgtaattaattttgaattaatctattttttgaagaaatgcttattttattttttattttttatttttatgtatttatttatttattttaagtcctggggcacatgtgcaggatgtgcagatttgttacataggtaaacgtgtgccatggtggtttgctgcacctatcaacccatcacctaggtattaagtccagcatgcatcagctatttttcctgatgctctccctcccccagcccacctgcccagccccagcaggccccagtgtgtgttgttcccctccctatgttcatgtgttctcatcgttcagttcctacttataagcgagaatatgtggagtttggtttcctgttcctgcattagtttactgaggatactggcttccagctccatccatgtccctgcaaaggacctaagctcattcttctttatggcagcatagtattccatggtgtatatgtaccacattttctttatcccgtctatcattgatgggcatttgggttgattgcatgtttttgctattgtgagtagtgctgcaatgaacatattcatgcatttatctttataatagaatgatttatattcatttgggaatatgcccagtaatgggattgctgcatcaaatggtatttctgtttctatatctttgaggaatcgccacactgtcttccacaatggttgaactaatttacgttcctacccacagtgtaaaagcattccttttttttctgtaacctcgccagcatctgttgtttcttgactttttaataatcgccattctgactggcgtgagatggtacctcattgtggttttgatttgcatttctctaatgataagtaatgttgaacgttttttcatatgtttgttggccgcttaaatgtcttcttttgagaagtatctgttcatatcctttgcccactttttaatggagttgtttgtttttttctcataagtttttttaagttccttgtagactctggatattagacctttgtcaagtggacagattgcaaaaattttctcctattccttaggttgtctgttcactctgatgatagtttcttttgctgtgcaaaactctttagtttaattagatcccatttgtcaatttttgcttttgtcgcaattacttttggcattttcatcatgaaatcttaattttgaattaatatttatttcaggactgatgtttgtttaggttaagtcttagttttatggggttggatgtccagttgtcccagcaccatttgttgaaaaggctatgcttcctccattgaattgcttttgcatctttattcagaatccattgagcatatttttgtaggttaatttctgtgttttttattccatacctttgtctatccctctgccaataccaaactgtattgattagtatagctatatggtggtgaaaatatcaactagagtgattcctcctactttatatgtctttttaaagattgtgtttagctattatagggcctattatttttcatgtaaattatagcataagtttgtctatgtctacaaaaatccttactagaattttgatagcagtttcattaagcctatggatcaatttgaggagaattgatatctttaccatattgagtctcactatctgtgagtacagtatgtgcctccacgtatttaggacttccttctttggtttctttcatcagcatacaaatcctataaacattttgttaaaattttaactaagtatttcattttctttggaatgtttgtaaatgatatcttctgtttaattttggtttcgacatgtacattgttactatgtgaaaatgtgattgatttttgtgttaacattttaaaaacatatttttttcaaatgacatatctataatgtgttatatctagcatgtagttcatttgctcaagtcttgatttttccttttgggactatgtaactcttttttctcattgaaagaacacagtaagtaagcatctatcaaaaagtacttaaagaacatccatttattcactcatgctatgctaatggtaggatttaaaagatttaaagagaagcttttactttcaagtagtttacctaagagaaaataagtgtgtaataaattgctgcagatactatgaaaatagtttagaattcagtggaattctgccgagatagagtagccccgttcctcttaagtcttccttcttacaactaaaaagtctgcatgtaacggcaaacaagcataagaagtctctgaaagatggaagaaatacctctgagaaagacctcagaacttgaagaatgacatggcaacatgtcatgttctcactatcctgtctgctcctcacagattaaggcatgaattcttatcattttttcactttgttccttcatttgaaattcaatattttcattgcctacctgaacaatacatatttatttctggatgaaaatccagtttatgtttactttctttctatctttcctataattacttcaaaaacaattgtttcttctacctattctggggagaaaacacactaaaacttagtgccttaaaacaataaccattttatttgcacgtgactctgcaatgtgggctggactcagctaggtggttcttccagtgatcttgcctgtggtcacctgtggctggagtccactgcaatacagggttggctgagcctgtttctctattatttctgagggcctctccatgtgctttttccatttatctatcaggtgagccagactttttatgtggcaactcagaaagtataactgcttatcaagcatctccttgagtcatgcttactgatgtctcatgagccgagttttgagataataaaggagaagactttacaagggctttgaggtgtggttcattggtaggaccaccaaagtaacagtctaagagtcaacctttgacccttaatactgtcattcatgtccttataaatgcaaagtatagtgaccccattcctaaaacctccaaagtcttatctttctgtggcatcaggattaggttagaagttgatgatcttattatccaagtcagctctgagtgtgaatgaggttcttcctgcttagttccctgaatacaactgctcaggagtggctgctcttcatccaaaactctgtgaactaaaaaggtatataatttggccctcacatagccaacataaatagtgagatagggataacatagctaaaccaaatatccccatttgaaatgggggctgcggataggagatacagagcagtcactggcccatggcaattctaaaattcagctggatacatggcaccagtttattttattcttttcccaaggagagtaaatatactttattttttattttttttattatactttaagttctgggatacacttgtagaacgtgcaggtttgttacataggtatacatgtgccatggtggtttgctgcacccaccaacctgtcatctacattaggtatttctcctaatgctatcactcccctagccccacaccccccgacagaccccggtatgtgatgttcccctccatgtgtccaggtgttcttattgttcaactcccacttcttaattagggctcagttctggttactggaagtggttctctgatattcttgggtccatgctcttcctttctatataaaattaatggcccaggcctctttgcaatttgaactttatcccttttggtataaggtagtatcgttccttaaaatgttgtgaagcttccatgtattaagttgtaatccacttcatgaagcagaagccacacccataaatatcttcaggaaagatgcccctctactttgctgttcaagtcaggatgctggaggacaatgtaccaaagattcttaaatgagttttgcctagctagtcttagggcatgcctcatagaccctcctagctaagaatcttagagtctgccccatagactttcttagctactttctctggatgatggagtatgcattgtataccaaacatattaccacagacatttttccccctcagaatcaatatgaggtgtttgtcaatgagaaagcactcaatacatatttattgaacaaaataatgagtgattgaggttagtgttccttagaataccttgtggaaaacactgctatagacaaaattaaacaattttctgattcctatcattttccataagaaaataaaataattctttttcttatgacatctcttgtctgaaaccaacacaaattatgaatggcttgtcctaaatcatgatttttggtatttcagatgacaattttctgtcttttgacagaatatacctttactgtcacctggtggaaataaaaactaataaagtgttagatctgatagacccaaacaagtaactgctataactgtagtataaacaatttaagtaatttttaaaaatctgtatgatacagtatacttttaatatttatgaatttttatgtaagttatttaaaaaatcaagtcattcttgaatcaaaggatatataatgtcagcattattttagaaagccttaaacatttatgccataaggagtcttcataatttgttcagggcaatcaaagtccgtataaatgttttatatcctacccagtaattttaatgattgtgtgcatatgtgttccaaggatctagtgtagtttcacaatcttggtttcctaatttttaaactatctctcttaattgaaaccatagtatacccttgagaatatcagctataatttataggttataaaaatgcaattaaacctacataagccagtccctttaaaaaaaaaaagtcatatacaagtgaaagtctttaaaataagatttcaagtttggatgtagagtctcttatagataatatatttattttgtaaaactgcacatcaggcactttctgtagttttttggtagagacatctttcttgccatagtaggtttcaatgagatttttcagctggataactctgatgattcttggagatggtgttgaagtttaagccatatttccatgtctgagacacgaagacattttctaatggatcaaactacttttaacagagcaataattagccaaattgctatatttctgggttgtgctcttttcaaaaacaacaaattcaattgatggaagtaaaagccaagagctgtgtgaaatgtctatttgatttactgattttttttaaccatctaggaaatacatgtcttcaacaaaacagcctattttttttttttttttactaagaagatgaaataaattctgctggagtgatcatggggtagtttcttagatcactggattaagaaaagctttgtctaatcttaccaagtcctataggagagacagctttgagaactctttgaaatcaattgtgtcatgttcaaggcagagacttataaattttcttcaaaaagtatcaaattaatatggagtagatagagtactggaaaagatacatttgtaaaataattaggtgcataaagtccaatttgagattttatgtagtcttttttgttttccattttaggtcaaatgaatcaccataggcccttttcaaccatggatataacatgtgtatttatcgtatttcacaaacattactgaaaatctaggacatgacataattggtaattataatgagggaattttaaaaattacaaacaacatatgccaggcaaacaaatcacttacaacccaacaggactttattggtggctatacagggttatactgtgattattactatttgttctttatttgtaaaaaactattctccaaaaaaaataaaatgttaactgctaatattgatgcactaagtgaagagaaattgattaggcttaataaagtagtagctgctgatcagcaaaatttgggataagtgataaggtaatcacttatttgagatcagtgaaaaagaataggaagttaagattattccaggctctttctaaatctaattttgtgtgtggtcctaaagtaaaaaaaaaaaaataaatgaataaaaatctcatggaatgtagagaagacaaaaaggggctgattaaagagcgtatgaaggacttgtgatttgagcagtagtttcaagactaaactcatggctagggaaagtgtaactgggaaagatttctgttaaaaggtttcaggaagactactacaagaaaaattaaataatgaatgaaaacaggggttggcaaactttttctataaagagtaaaattgtgcactttgggaggctgaggtgggcagatcacgaggtcgggagatcgagaccatcctggctaacacggtgaaaccccgtttctactagaaatacaaaaaatgagccgggcgtggtggtgggtgcctgtagtcccagctactcgggaggctgaggcagaagaatggcgtgaacccgggaggcagagcttgcactaagccactgcactccagcctgggtgacagagcgagactccatctcagaaaaaaaaaaaaaaagtaaaattgtaaaaaattttagatttttcaagccatatagtctctattacaactactcaactatgttgtaatagctagacaatatccatacacaagatataaatgagtggacatggctgtgtttcaataaaactttacttacacagacaggtggtgggacggatttgggctgtgggtcacagtttgctgacccctgatctagaaaatgccttgcagctgtcaaatagcaaagccaacagtagcaactgttgttattaacaaagaaaaagctacaatatattcctgataaagcaagtagatcagtgttgttagaaaatgggctttctgtaggtgatagttagaaggatgactgtaaataatggtaaaaaaatgctaagacttcaatgccaagaaatatcaagcagggaatggaaaacagaaagcagttttcctggaagtaccttacaggaattctatgaaaccagagaaattagaaaatggaaaacagacaaggagtgtttacaataaatgaggcataaggcaatggggggcctatgtttagagtattaatggtagaagtgccaaagaaaataaaacagattcaaggtcatttttggaagaaaaaaatccatgagagatgatacttgattggatatattctgagcttcattggatgttgctatgggaaataagtaaaagagacagcaagaggcctatcttaatgcttttcaatacaaacctaaacatttttaccaaaacaactcaagctctgagaaataaaatcgcctacactttaagctattagacagggaaacatgtaaataaagttcccccatcgctggtttgccatagagcatttgaataaataaaggaaggagtttgggggtactttctaggttctctgatggtctgcttattagtctttcccttagatcatcttaaaggcaaaggtgtaactttgcatctttgcatctttgcatctcttattacacatatatgatcactgagatctgaacagagtaaaatcttttgattagttgtcacagtttgggggtggctttgtgtataacaagaatcttagaaataacggtggcttaaacaggagagaactttgtcagggaaaagtccaatatatccaaatttcagagcggatgtattggctgcctaattgtctaggcctcaggattctgccctctatagggtatggtcttcatccttattttcccaagatgaaactctgtccatcatatctacgctattacaagctcgaaggtgtagactgaaaggaacaaaggacatgatccttcccacctttaagaacaagtcccagaggttacttatatcacttttacttacattcataggccagaacttgttcacataactacaccaagctgtagtgatggcttgggtatgtagtttttgttagtaaaacccatgtgcctgataaaaatactactaatttaaggatttcaaattgatttccctaagagaaaagcctaagatagggattcctgtgcaagtgagctatgaagagagtgctctcagaaaaaaacctgcagggaagaagtcaggcagagatgtgttttcaagtctagcttcagcctgatcccacagggagctgtggtgcataaattgcatcacagagtttaatctcacattgaagcaagcctggacatcgcaagtatctctatctgagtggttcttgtcataccaaggtgattatcaagaaaagggtacagctatgggccttgaccagctagtacccacagcagctagagaatgagtacaacagctggtgaagaaattctgggtgggatgtcaaaagcatctgctacactgaagaaggaggacagattttgagggaaaattagtagccatttttgtaagagccaaaagtatcccttcacacatactgagatgactcaatatcctatttctgttttgtacatggttagtactctatcagtatttgtagaatgagtaatgcatattcttggacaaccttctttttttttttttaatttccacagccatcctttaccatttttgaaagtattaagaaatgttaatactttcagtaccaccatacctacccccagtacatacacaagcatcctgccctcaatagctatttcctctactcagattctaagtcacactcacaaccaattgtagaattacctcactggcattctgaagaattagctggcaaatttcctgcattttcaaatattttaagttccggtttccagaaaaattctccttgccctggaaataatagccagacaactatgattagaatatatataacctgcttatattcaccttctttaaatctttggtgaagaataggtatggcttttctcatcggtttgctctggcctagatttatgttggttttacagtgacatttctgactttcaggcaagtatccattgagtaactgttttattatacaaaatctgaggttataaaataaagacttaaatgagcatttcactgatttcattatatctcacaattatagatctggatctatcaattttttctcatgaaggtcccaaaagactgttctataagagccgtgattatggagtgaatgagtcaaatttgaagtctggtccaatggtttcaggaaaatgttttatattgttctaaagccaaaaaataaagaaagaataaagcatcatttcaaagcactatcacaccaggttggattagttaggcttcatattacagaaaagcagcttaagtaagatagtttagtttctcacgtaaagtagttataaggtaggcattcctggacttttatgataatttcaacgttttgcatgacttaggctctaaagctttatgctttgccattctcagcatgtggcttccattcccaatgtcactacgtgctcctaatacaactgaagaactgaatttttaatgttatttaattttaaatagccacatgtggatcttagtctttgttttcaaatagtcattacaagctgtttgtggctactgttttagaatagaaactcttctggatagctcttatttagcctggaatcatgtaatgtaaacatggaaaagattttagatttcactgtaggggttgcttagttttacagataaacaatggaggaagtccaaagaagtattggctttctagaaattcaaaactaatgtttagaaatactgaaaatcgagctggatcttttgatttcttaatcagtgcactcataaaaaataatttattaaaaatattttgtaattgaatttgttgattattcaggtagatcttcctttatttacttaaaaaagtaagattttaatacaattatttttttcaatccattcatttccaatggctaatttatttgaagaatgattgcagcaatctgacaacaaagttttaccccatctactctagatattgaggcttaggctgtgtttctattcttgactctataagccaatccattaaatgataagctaacaattaatttacattaaaacaagactactatttctgttactgtagaagttttagaattagttgcatgtaagttaatgtgattaaattggctaggaatatttgatactgtatctatttaatttattcttttagattattaagtatctattctatgcaagccattaggccagctgttgggagcacagcagtgaattaaaccacagtagaattaagctagaatagaacatgtctcttctggaagtttattctagaaaagagcctttgaaacagtaattacttggatcctaacttttatgaagagaaagaacaaggtgccttaagatcaggcaacaggctggcttagcccacttggtaaatagtctctccctcaaaggctcaacctcttcaaactgaaatctgactacttctgaggttgcacaaaagttccacagactgttccgaaaaaaataatttgaaggaaattcatctccagaacctcaactttcacatgtactcttgtctaaaattgcctgaaatctcagaatagcatttcctccaccttacaaaagaaaggcacacctttcttccttcccaaattgtagcatgatgcattgccccagaacttagggtgccaaacaaagggatagtctaaaatattactttgaaaactcaaggccccttaaactcagagatcttctcctgcctgtgtttcaggaatttttgataacttcagtgcttaatcaaagttggtatattcctaattcagaacagccaaagccttatatagtagtgatactgaattgtgtcagtgtaattggaatgttttataggactatcattttttcaagatgcatttgataaaactcaggaacacactttacttgtgatggttaatactgagtgtcaacttgattggattgaaggatgcaaagtattgatcctgggtgtatctgtgagggtgttgccaaaggagattaacatttgagtcagtgagctaggaaaggcagacccacccttaatctgggtgggcaccatctattcagctgccagcacagctagaatataaagcaggcagaaaaaaaaaaacacgtgaaaggactagactggcctagcctcccagcctacatctttctcccatgctggacccttcctgccctcaaatattggactccaagctcttcagttttgggactcgggctggctctccttgctcctcagcttgcagacagcctattaagggaccttgtgatcatgtgaattaatacttaataaattcccatatatatgtcctattagttctgtccctctagagaaccctgaccaatacatttgttttctttcatatttgatgtgcattgtccaaaaataacacatggaaagcctatttcattaaatcatgtactatgtattccacttagttaattctcatcatattccatttatacaatatatagtattttctctctcctattaacaaataactaaaattatttaaacatacaaaaatagatgtcacctttaaataataggtttttataagtcatttaaggtaaatgtgacacaaaaaagcttggaaaccccttttcagggtttctcaaattataatcgtatgtctaattagattaaaaaaggtcaccaaggtgctagtgaataaaacaaacaaacagattcctagatcctaccacttactgttgaatcagaatttctggggaaacaaggatcagaaatctgatggatcagcatgcatacagatgattcttatccacattaagtttgtgaatttatattcaagtgataacggttactatggtttggatgtttgtttccccaaacctcatgttgaaatttgatcccagagttggaggtcaggtgttactaatgggagtttgagtaatgcgggtgtgtccttcatgaaaagattaatagcctacttcagcagtgaatgagttcttgcttagtttccaggagagctggtgctttaaaagagcctggcacatccaccttttttctcttatttctgctctcatcatgtgatctctgctctcttttgccttccactataagtggaagcagcctgagttcctcaacaaaagcagatactggtgccatgcttttcgtacagccttcaaaactgtaaactaaataagcatcgcttctttacaaactagctaacctcaagtagttctttatagcgacacaaaaaatggactaagacaatgatccttttaagagagttctatcccatactaattcaaagtcaacatggtgtttcatataatcttgttgtaatagtctcttggtggtggacatccggcacctaacacagtgcccagcacatgttggagtgtcaagaattaatgattgaaagtgaatggaaaaaaggtatatatctcctcccaaaacatcaggagattgaatataaaggacacatcttccttctataatgtgacagatgcactctatagttactgtttgagagtttttttagtgcaaactatttacctcttaggctaaatttaatttacaaatggaatcattagtagtgaagatatagcagggtgccttccagattcctctgctgtgatcttcaaatgaataagcactgcagattagtcaaccttctgaaaagttcttaattaaggaaaccaatactgtgcagaataacagcctgtgtgttaaccttgttgacacagtgtagaaatctcatgtagatagctagtacaaaagaataaaaatgttgttctagtttctaaagtggcgtttccaaggaattatacttctaatgaaaattgctgctgtggatgtctgttcaaaggctttggcttacaaagtaaagatttgaaaatatcaaacttgcttaatctctgaatgttgttttcattcattaggtgaatatgacagctctctctttaccctaatcgccccccctggaggaaataacatttttgtttgtctaaacagtacttaatgactactctaaaattagagtttaagatctttaactctagagtgcaaagctctacgtccttgactctgacgtttatcatgaatattaatttctgatcttaaagtcaagccatgaaatttttatatattatcatacatttcccttgacagtttttgtaattgccgtaatttcctcatcagcaagagttgtttgtggctctcctggtctgaggaggctataaatttggcagctttgaattccctcttttgtttgaatgtggaaccatcgacttgtttactctgaacattaactagatctcagatcttaaaagaactatagtttttattggtgcctttacatgacaaaagactcaatatatttgttgccattacatgttttcattgttacctttggattgactttcttgttaggggagatttatgtccatcttcagatacttttcctgctactcacataaaaatgttattttctgccacatagctaccattttctttaaaattgatttattagtagtgtttgattatcgaataccagactgtatatattcacattgtgtataagtatccaacatgaaaattatttagacaatattcatggacatgtatacataaacacacatactttttaatatatgtaattcaactgaaatgttatcttccgtttgtactttcaacaaagatttatcgaacatctactacacatcaggcctggatttttttctgcacacaggaataaaaatagacaagacacaaattggcctgaagatgccacagtcaaccaggcaaacagacagactcataaaaaattatctgtatcactgtacggcaaatgctgttaaaaatatggtgacaaagagctgttgcaaccagagagactcagggatggatacacagaagacaggtctctgaggctacacgagatagatctttcttcccagagaaattgaaagggcatgttattttacacagtaggagtggccagacatggtgatttagtaaaagagcttcagaagggaaaagcaacagatacacgtggctggagtgaaaagtgcaaagtggtgcgtgggaaagaaacagaagctagaaagttaacttttggatagatttgggaagtacccaagaatagaatctcaggttcaggtgtttgactttttttttcttaggacctgaagacagtgatccaggatggcctaaatgtcgcagagaaaattattctatatattcagtcattcagacaattatctaatgaattctttatgagagttgtttttggccaggtgatgaacaagagtcaaagtctctgttcttaggaatcttatagtctttcaagagagaaagttaagtcactcaacgtttaatgtctgatatgacagaggttacaacagagaaaagaacagagtgtaatgggcacatagatgtgatgtgtaattcagaataaaaatcaggtaaggcttcttggagatttaaatattgagttctgatacagaagtaaaacttacctggatgaaataaggagatgaaaaaggagatttggaggagatcctaggtggtaagatagtatatggctacagtcattatatattcttctaattgtccacgactatagtaaagttcccatgacttgggtcatttttagagaagttggaaaggatcagttcatggtcttggggtacaaaacgggagagctgaaactttacacaaaaaggttcagggagacaatgaaaaactttaatcagatggatgacaaaaattggatttgagttttggggcggtcatttagcagcagtgtgtggggatgttgaatggagggcttggagagtagcatctaactacagggttgtcttagattggactcctctagaaacaaaccgcaaggaaacatcactagaggaatggggaagtaagatgtagcagagaagggaagccagtaaagtatgcattataaagctgttttatcccttttggcaactggaaattaggtttactggaaaactctgtgagacaatgtagacatactctcagagttatacccgaagggagaggaaactgggttgtttttctaccagctccctacctgttcctgattgagggtttcttctactaggaatcttagttctctagcatttctggcttgcccttcatgaagaccaaggttggtctcagggccagacaaaagccatcagactgagggtgtcacgtatttgtaagaagcagccttcatacggtagacgtttgggtggggcactgacataatcagctaaagaactaacaagatgggaggtgttgagggtctggacttaggccatgatagtggtaatccggggaagtttgggagtgctactaggccattgttttaataagatttggccatgcattaaatgttaggggtaaattatgaatgatgactttccagagagtagacagatgttgatgatgtaaaatgtgtgtgtttaacaacgtaaaggttttagtataaatatgaaacctatattaaagtctctttataattgtatctattttagaaaagtattataatacagcagtataaaaactctctaaccagaagacctagagtacttcctagatccagatttctaacagcatgaatcttggatgatactcttaatctctcagagcgtctcatgaaaaaaatggaagtaaacatgaaagaagctttgcatatgttacgtaaaccaaagtgtcagtaagccttgtacaaaattttaacttttaaatagaaattacataaagtatttgggccctaggacctaccaagtcgattattattaatgaatgagtaaatctagtcaatcaaagacctttcatttttcccacacctatatttgaacagatgccagttagtgagcatctttgtttgttaatatctgtacttcatacttaatggactaattttttctctatcaaaaaagctgcctttgttaaaacatttcaatcaactaaattacttaactctaatgcctattttgagggaaaaatatacttagagggagaattaaatgtgtaattttatttctgcctcattaaacctcctctgtgtctaggccaacaagagtttcctcctcctccaccggcacacacttattggacgcttcattgtgagaaaatcctcaggtcgctggaacttggtagtgagttacatacctgcccgtcccctccagtatatgtactaattatcttatggaaaataactattttcttgcttttttttttcctcaagaaagccttgagtctcatccagaagtcagatgagtgttagatttcttccttctcttggcttcaatggcaactcttttttttctgattctaaataaatagattgttatacccacatgaatatccacaggaccaacactgcccctttattactcaggaagtatttatttttcagctttctctttcctttctggccctttgaaattcaagcttatttaataatgaattttagtgaaattattttaaaatatcttttaatcacattagcaaacttctagcagagcattgagtttcttcctcagataattcaagttgtcttttctaaaatatgtacttaaaatgactttgaaaaaagagatgtatgatgtcagaaatttctttcaaaagaatctgggtgtggttggggtgatgggtagggatatagatgaaattaaataagcgctatgttgataaatgttgaagttggatgatggtatatgggagttgtgtagtgttttctacttttgtatatgtttgaaattttttctacacttgaaaagataagagaaatttaaaaattaaattggttctcacaattttatttttgtagctgttttttatttgagacgaagtttcactcttcttgcccaggctggagtgcagtggcacgacctcggctcactgaaacctctgcctcctgggttcaggtgattctcctgcctcagggcatgcatgtgtacaagcaatgcccttaccatttatgcattcaactattcttccctctacccattatttaatataagaagtacttatgatgtctgtgctgctgactgtgctaatcattgaagaacctagggtgagcaaaaacacacacagccattgccttcataggactcatagagaaatgagcaagaaacccaatgagaaatcacacaaataaatgtaaaattgcaaaaataacagctgttaaagaggaaagatacatgattttatgtgaaattataaccgggtggtattgacttgatgatttgagaaatcaggggaggcttatctgagtttgtgctgatttaactgagatcaaactttgatcttggtgtgtggagacatagaacataaacctcaattcacccatggtagacatgtagcttgagtgagaaaatgtaactttgttattgaaaaagtcatgacaattttgtaatctggcctatcctgatgaacattcatagggttatgatgggttatccttatatatcttgagaacaccaaggacagtggcagagcttggagtgagaaggaaatccataaaccagatgccaaaccttcctggagtcagcatagacatgaaaatgcacaagagggcaaaagagttatagaaccaactggtatgcatttcaaaagagcaggattgtggagaagagagtggatgaattattatttaggagctggaataggaaggaaggatatcaagcccagtccctatctctgaaatgcaaaaagtatgaggaagtaaataagcaccacctgagatagctgtaggagaagtgataatcacagaggagagctaggtttgattgggtgaataccaagaagagaaggggatactaaggatttagagcggttatatgagtatggaaatattgcatcaaagggtacagtgaaacaatttgagccatgagatgtgtgtgtgggcacagaatatgaataaatgaatgaatgaatgaataatagcattatagaaatgctaatgcagtagaagtgtatgtatatgagtgtgttggagaggggatgcttacaattttggcattgatttgttaaactaaggatgacagacatcctgaattcaaccttaatatctctttgaggaagatgactcacttggttgggggtgatgggaaacccagaggcaatagaatccatatacttttgatggtgggttgatagtaaaccagatcttcagatccccagtgtccattactacctacgttgtagtctaatctctcattaattctcacatgtttaattccctccaatccagctgtcagacatttttattcctctctgcttagaaattgatatttatggggggccgggcgcggtggctcacgcctgtaatcccagcactttgggaggccgaggcaggcggatcacgaggtcaggagatcaagactatcctggccaacatggtgaaaccccatctctactaaaaatacaaacattagctgggcatggtggtgggtgcctgtaatcccagctactcgggaggctgaggcaggagaatggcttgaatctgggaggcagaggttgcagcaagccaagatcgtgccactgcactccagcctggtgacagagcaagactctgtcaaaagaaaaaaaaaaaaaaaaaaaaaaacgaaaaaaccagaaatagtttatttatggccaggcgcagtggctcatgcctataatcccagcattttgggaggccgaggtgggtggatcacaaggtcaggcgttcacgaccagcctggccaatatggtaaaaccccatctctactaaaaatacaaaaattagctgggcgttgtggtgcacgcctatagtcccagctacttgggaggctgaggcaggagaatggcatgaacccgggaggcagaggttgtagtgagctgagatcatgccactgcactccagcctgggtgacagagtgagactctgtctcaaaaaaaaaaaaaaaaaaaaaagaaattgatatttataaaatataaatgtgaacttgttatctcctgtttaaaaatccttcaatgatttttcaagctttccagataatatttaaactgtgttaaaacacaaaagccctttaccgtctctcctgtagctactactttagtgtcccttcaaagcactttcccctactcatctttcatgtcagcaacagaactattttaattttttaaagctttcttgtttcatgctgctgtactggtgtctgtgctattcaatctatctggaacctccatcctaacctctttgtctggttaactcctccccaaagggattaatgactgaattaatgatgccgcatatgtttttctaatgttcttttgaagtaactcaattgactctgaaagtttcagaaaccccttgtcaagtactgatcaagcagcttatttcactgcatattttttaaaattattttttcctgaagtttcagaagtcatgactttatttcctttggaagtgttcaatatttatgaataaaattatgaagataatcatgtaaaaacagcttaataaatttaaataaattttaataaaataaagagatgatgaaaaaaaggagttatgaaaagccataacagcagagaaaaaagaagctacaggaagtgtgaattggaactaagatagaactatacatagcataaatgggaaatgtaagaatgtaaaatttgtgcacttgaagaaactgaacacaattgcaaaagtttattttgataagtggaaaacattgtcatcatttgtacatttttttcccttaatagaaagcttcttaaattatatctaagcacttatcttattgcactgaatgtaagatgccaaatatagtaagagacacaatcaacaatgctttcttatagcaatcataaaagatatacccaattttggagatgataaaatacaagcaaaatgcacatcttagaactgatgaaatctggaaattgatgaaaaaagtcaagtaactaggttattgcatacatggtattagaaaactgccaaaggaaatttttaaaatctttagaaagaaaattatcaatactgcttgatcacatttgatatgaatttttaggaggacacaaatattcagtccataacactctctgagcttgtcttcttcaagattctttcagttgcaagtgacagaaaaccgagatcaaagactgattaagcatagaaagggatttttttgattcacgaactgaaaagtccaaggatagcctggctttttaggcatgtctggatttagattagaggctcacatgataacagctgaaacattctctctttttcccacttctttccttggtgttggctttattcttaggtaggcaaagatgacccctatctcctctagtcttagattctactgtcttagccaccagagccagagaaagacatcatgcattcctaaatctccaacaaaaatccaaagtgtggctctcattggcctcatatgtccatccctgaaccaatcacggtggccagtggaatagaatattcagattgaccagttctcaggcataagaaccagagagaatcagtccaacttgaactacatgctaataacaaaagaagggagaaaatgttggataaggaaaaacagtagaggagccccagtactcactaaataggattaatttcttaaatctgcaaactgggagaagataccaaacctttaggactgctgtgaaacagaattaaacaatatgtgttattatactgaattgcactcatgtgactaaattattacacaccacatacccgtatattgcaaaattctaatttcttaaggatctgtccttgacttcattgtggcgattatacatcccccttgtagcccacgatagaaatgatcaatagaaaacattgtccaagcgtcctggctttcctcaggcaagatgttagttaatgagacctcaacaaggatgagtaactctttccaagggacatcttcagggtctccctaaaggagaaatcaatgccccctaactgatttggatgaggaagccactagggtctcaggaagtcccccattgaaatgcaaattggtctagctagggctttatcttaaacaccagcaaatagctcagttattacttagcacagctgcagggattatcaaaacttgcagttttgttgtcctataggacataagtcaatattgtatctaactttgcaatcttattctatctcttttagtcaaagcgatactgcaccaggcatttgttaaaaaaatggcaaggaaaactttattcaaagctattgtaatatcagttaagactattgcaataggggcaagaaagtatactcaactttattgaaatgaaaggcaggagaggttttaagccttagggtgagctagaggaaaagcactggaagacactagggggaaggtcggtcagggtgattgggcttatcaaaattaggctcctaccctcccacagagactgagaaatgaggatgttatctttcttgatgattggatttcaaaagaatggcttccaggtgcttgagaaagacattccagggatgtagaagatttacatctcaaagggacagagaatacatttacaatggaaagttttctaaaataactgctccaaaaaaagggcggggctgggctcagtggctcacgcctgtaatcccagcactttgggaggccaagtcgactagatcacctgaggtcaggagtttgagaccagcctggccaatatggtgaaaacccatctctattaaaaatacaaaaattagccggacgtggtgacgggcgcctgtaaccccggccactcgggaggcttaggcaggagaatcacttgaacacaggggcggaggttgcaatgagctgagatcacaccactgcactccagcctggggagacactgtctaaaaaaaaaactggccaggcgcggtggctcacgcctgtaatcccagcactttgggtggccgaggtgggtggatcacgaggtcaggagatggagaccatcctggctaacacggtgaaaccctgtctctactaaaaatacaaaaattagccgagcatggtggcgggcgcctgtagtcccagctactcgggaggctgaggcaggagaatggcgtgaaaccgggaggcagagcttgcagtgagccgagattgcaccactgcactccagcttgggcgacagagcgagactccgtctcaaaaaaaaaaaaaaaaaaaaaaaaaaaaaaaaaaaagaaaggaaaaaaaaaaaaacaaaaaaagggtaagtcgggagcttattaaggaaagaatcctagtctctggcattctatttgggccaactttgtcatccttgtaattccctctaaagctttggcatgtgctcacactatatccgtatgaagttcatggctttatatttataaaaattatattttgacttcttttctcttatattagttggtagaataagcagaaatcaaagaagctgaaactagaaaacagaacatagcaaaatagcaacaaaaagacattaaaacacaaattttgaaagggcaaaaaatcatttttggaatctgactaatgagacagcatggggaaggctaatggggtaaggagaagaacaaatagaaataattgtctttggaatgtgaacattaacataatggagagcaatgaataagaagtatgacaatgttaagtattttatgtcattgtcccaagaggtgctcaattgagaaatcacacacacacacacaactttaattataagaaaaatatgtggtaacaaaataacaggaaaactcagaagtcagagaataaattgcttattaccacctcctaagtagcttttaatgctctttctaaattttctttgtaaattcaaaagttaaattgaattttgattcagacataaaatgaaactgggagcatttatttctgtattgccaggagaaatatttaccttgatttatttaaattcttctaggcattcctatttattcaattttataaacatcctcttctttgatgttactctaagtttattgtttcattgtctgagaaaaatcttattgccatttcctaaattggtgtttttttccccatgaaatttccagaagcatccaaatgactggattaaaatgaagtatggcaaattgccttttagaatgactcttcccaattagaaattgccaaaagtagagatcaaagcagtatacagtggttttaaactagctcatataacatcttccatgagctagttatataaagatttttgttttgattacttttatcttataattattcttaccaaattccaaccataaaagatattttgtacataataggtactcaataaatgaacattacatttgaaaagcaatgacctgctttatatttcagtctaaatgtaatcgatatgaatcaagcagtaaagaatatggcagagttgcattacaatttgcagtccaaaaattcttgagtaatctcaggaaaaatgtactctaccagggctttccaaagatcgttttcaggaatactagcctgtctatgtgctgccaaagcgagcacaggaatactagcctgtctagatcaatgcagttaacacaacccagtagatctctgtgcttgatgatgaaaatattctatgtctctgctgttcaatacaatagtcaatagctatctgtggctgttaagcacctaagatgtgactaatgcaactgaataacaatttttttcatagaaattaatgtaaatagccatatgttgctagtggctacggtactggacaacatagctccaaagttctcaagaacaaagaaaaaaatttatttatttttctttaaagaacaaaattttgtctaacctagcatttcccaaatttagttcatcacgaaattcctctttctactttgagaagaacattagggtacacttttcaaaaattttatattattaataaaaaggaataagatgtttaaggccatttacacatgattccttattttatttgctgattcatttatgtatccactcaactaacatctaatgagctaggggcttggcaatattgagatacagttttgttcattattgagttatatctaatgggacaggcagattaatcaagagataattacacacagtctggtaagttctaagaaacacagaggactgtgggaatacacaggtgggtgcagaatcaaaatttgtcatggggaaagtttccagagggagaatggaggacaagtaggacattgtctggttaaaaagaggtccccggccaggcgtggtggctcacgcctgtaatccctgtgctttgggaggccgaggagggtggatcgcctgaggtcaggagttggagaccagcctggccaacatgatgaaaccccatctgtactaaaagtacaaaaaaagaaaaaaattagctgggcgtggtggtgtgggctgaggcaggagaatcacttgaacctgggaggcagagattgcagtcagccgagatcgtaccactgcactccagcctgggcaacaagagcaaaactccatctaaaaaaacaaaaagggtgcctttgcatttttatttctcttattcccctccccagggtttgacacttagtctgtcttattcaagctaagtccttgaatcacaactatgcctagatccttatgggttgcttatttatacctttaaacaaagagaaattcatctgatttttacagattgatttgagaattagaggctgttaatactatttcctttttgccaccccaaccactttttcctgttctaacttcttcatactccagtatacaccacagaaacagaggctgatatggtttggctctgtgtcccacctagatctcatcttgaactgtactcccataattcccatgtgttgtgggagggagcggtggaagataattgaatcatgggggtggtttctcccatactgttctggtggtagtgaataagtctcacgagatctcatggtttcataaggggtttcggctttcgctcctgtcttattctctcttgccaccatgtaagaaatgcctttcaccttctgccataattgtgaggcctccccagccaggtggaactgtgagtccattaaacctatttttcttcccagtctcaggtatgtatttatcagcagcatgaagaaggactaatacagaggccattcgtactttaaatgtattacggctaattatagtcaagagattagaagtcataatacaaatattaaccacagagaggtttaaatttctctatataatctacagtcttctcaaaatagccttcaaaattttgacctgagagcaggaacaggcctttcatgttttaatcctcaataaaacacagacatacaagcctgtgtgtgtgtgtgtgtgtgtgtgtgtgtgtgtgcgcgcgcacatgcattctcacgctcatagtctgtcttttcccaacttcgacaattgtcccactgatttctctgtaccttcctttctattttaatcaaatctccgcaaaataaataagggatattctaaaatgtaaatctcattaagccctcccccagataatactcttcaagagtttcctcagtttccttcaaaatatgttctatggccattagagtagtttaaaattccctgtataatctagtccaagtttatttctccaacctcagagcaaacaattctagaacagtgtctagcatataataaacacccaataagtgttggctattgttttaggaaatggttgtctgtccaggaagcctaaaaaggtgtcaaaccacaatattagggaggcaatgcatagtgcagccaattcacaaaagagaaacaagtcctagaaatgttactaagagctcaccattcatgacaacactaatctcctcccgcaactctgccctcacccttcattctttgaggcttcaaaggatgaagtttatccattcatatcaaaaccttcctttttcacatatcaatgcacatttaaaataatcttgtagacactgttttctccttaagagtctgagagttaggaaacaattctgtaaatattaaaaacacaggtattgtaagactgattggaatcttacaaactaattttgttttactaaccaagacagtgtaggatagttacacgaacccaggtctagtaaataattcattcgcgattgtgggattgagtgcaaataattagtgtaaattgtcactttctcaaaacaaccgccataatagcctgttgattaagcaacgctgagtttattacttagtgcagtaataaagatcaacacttgacacagggtcttagttctctgaagacagtggttgaaggtagatattttttatagagttttgagggggtctaggttcaagtggtttaaagaagttctttgaatgcagagatttgattgaaattgggcaaaatccaagatataatagacaagaattggtggacccagtgagtccaggttcttagaataagtcttgatgagtaaatagctgttgaataagtaagggagttcatcatgttaacaatccattgtcccatgaaagggagctttttctccaaataaacaacttattgtcttaagacagagctacttgatcactgtgtagttcagataaatgcagtttcaggaatttcctgacgctgtatattagtttacaacattatttcctgggaaaatgttttgtggaacaaaatgcaaagttatattgacgtaggggccttgataattaagttgagcgacaacctctctgagtttcctcaattgtaaaatggggataccagtggcacctttttcttttggttgttttgaggatttagtgaaataatgtgcataaagtcctcagcaggatacctggcacttagtaaaagtacaatggctgttaaatatatttttcaactactttcacagtagttactcttaaagtatcaactcattttttcatccactcttctaaaacattcaccaaaatattatatgccatgttctttgctgtgtgttaggagcacagggatgaaagaaccatgtactcaataacttgtacttatagacatgttaccctattactggagactgttttggtaaaaataggaataacatgccaaggcagctcaggggatgtaggaaagtctaaaaacctgtcctagtgaaactgatgcttgacctgggccttaaaggatgagtaataatccattagtcagccaagggtccgatcattccaagctaaaggaaaactatgtacaaaggctaggaactattaatttccatgctgggttccagatataaaggagaaatccatgtgatttcacctaaagggtcagatggatcagcagaagatgagttcggataacaaaaataatagttaatagaattcaatatatgataagaatattcggtgtttataacaaacgggataattccaaccagaggatggaaggatcaaaggttttttttctatcaaggtgtggagctggggtcctatcttacacagtttagtcattctcaaatatttttatacaccagaaaaacatggaaagacttaaaattgcctccgtcttgctcaaaccttccgaagattccaatttaattgatctgggatggagcctgggaatctatattttttatttttgtgtgtgttttatttgtttagtgctctcctagtaatactaatatataagtaggacagaaagctgcctgcagtaagcagtcacaacccaataccagtagttagaagcccaaaatgagtcatttaaacaatattcttaaggtccacgtgcaaaattctggaaacaaggagtcagtagaggttacagaaggtaattttagcagcagtgagaggttgaattaggacagtgagttttcagtcatttctgcttatctggcacttgctttctatgaagaaaaggaaagagcatattcagatactcccagtgatactggagtcatagtctcaggctaagatagtgggcatgagatgagatggactcaaaagacagaagtagatgttgggataaattagagtattgggataaagaagaaagagagagctcaaagaacaatccaaaggttgtaactataggggcaggagcagtaggtctaggatgtagataaagaactaatttgaaagtgttgactataggcagcttcccaataaaccatggctaatacctgagccattatttctttcacagccccaggcacaactgtgtggtgcctcactttctgaaacattttaacagtctcctcctttgtatatgaccccagtgccctcaggccattcccggactgctttcttggtttcaaaatatttcctctacttaagtattggttttagaggagactgaattgagaattgtgctatagggagcatcccagaaccacgaaaatgacagtggttatgaactatcactgatgaacattttaggcaaaagtggccgattttgaagatgacctcgaggtcatccaaacttccctctttcctcattgccaaaggtcctgaggaacattatgaaaaataaaaattaaaggcaggtggaaagcccaaacatacgtctttttatttgtgatattgaattataaagtgagaattactaggctttgttgatggcaaaaccagactctgtaaaatattttaggcagtcagattacagtttggttttatacattttatgaaggcaggagttttaggcaaagacataaatcaatatatggaaggtacacattggtgaggcctaaaagggtgagatatcttgaagcaggggcttacaggtcataggtggattcggagattctttaatttgtgattggttaaaggagtaaaggtttgtctaaaaatttggagtaagcaggaaggaatgttttaagttaagataaggaagtctgttaatcaatacactgggtcagagtgacctgtaggggtgtgcgatttaacccttgtctgacatggccttaggtcctgtttataatttggtatcttaatgttgcagagtccattttgttagtctttgctctctattttacaataacattaatgctagtcagttgtgcctaaactccaaaagggagggggtataaaaaagcgtgtctgacctcctttcttgtcattgccaggaattcagtttttaaggtttctctggggtctcagtggctaagagagggtctggtccatttgtgacgggctaaggattttatttttagtttacagcaggatcaatgattatgtttcctaagggacctaattctagaagtccttcagttctccccaaatattttgggcccttgtgtcacaattgctgaaaccctgactccaaatttgggaggataacattgctgccagctttttactggtatcaagaaaaatgccagaaaatatgcaacatatgttgccattttgtcaaaagcagcaatgttaacatgacaatgaaagcaagttccttttggatttctttttaatccctggaaggtcagagggccaaagttttctagtaattcatctaggaaattaaccacctttggcttttcttactattttaatttacaattatgatttatagatgaacgttggttggaaaatatttttacacataatggcttttttagaatagcatctacagatacatgacagaaggataaaaattgtaactgtgacagcaatttcaatcagaaataaaaaccttaaggagcatcatgaaatttaccaaaatttatgcttctgatttcatggtatgtatttgttgatttgtttcttccccaagggattagtagtgaatatgtaagtaaaaaaggacatgattacacatgaaatacaatatgtcttctgggaaggtggagaaatctttcagccttagtggcattcacgtttgtgtggctgtgtatgtggatgtgtgaatttattcaacaaaaatgataccacttccatttgcatgatattgtaaagatttttttctttcccatatattctctctttttggtctcctgataatcctgcgaggtaacattaatatatgtgatacatttaatgaaagtctttgacaggcagcaacatatttgagaaaacaagcttgggaagtaagcaatattatcttcatttaaataatgagaaaaatgagtctcaaatagggtaagtgatctaccaaccagcacccagctctccaagatagaactgatactcaaaactaagtcttgttaacccagtactgtgcttgattcatagaaaatgttccacaaatatctgaaatttaattcatagtttgtgtaggtacagcatgcaaccaccacaaggaattttggctttctctttaaaatgtggacttttatgtgccaagataaattttctttgtggctgaatgtttttcaggaagagattactcaactaatttgaaccacattgacctatctgtaatttatggaaaagtgcaacataatacaggattatagaggctagagtcacgcttgctgaatacatatgctgtacattattttgaaagaaagaaaacattttaatacaaactatgtgaatttgatgacgcattttccctttatttctgttagtataaacctgcctatatctgataattgttggtgggcatgaagtaaaaggaaattatccccctttctgtaggttgtctgtaaagaaataaagcaaaagggaattagtacaaaataataacggtaatctaagcagacatagagttcagtgtttgttttatttcacagaaagatgcctatgcaacttgtgtaacaaattggtaggctgaaagaataacctcatgtaaatgaagaatgtaattaccatcttcacagttttggtacatgttggaaatgtcatttcaatcagggctaatcataatatgacaggaataactgtgataccataagtgataatgttatgctgctcactttttctaaatttggtggcaaaatatgcaaagataaaactttcaaagagccagtaaaacatgttcaagaattttctcactttaaaaaatattttcagggaagtactcatcattatagatcaacaattattttgataactccattgtttttaaattaaccctgttttagtattttggtcatcttttatggtcaattataaaagaaaaggatccattttaagtgacaataagtatttgatattttactttttccacatatatattcctatattccatatggcacatatgtatattttgtatatattccacatataatccatatatatatattagacacacagatacacacatacgtatgatatctgtctatctgtctgtctatctatctatctatctatctatctatctatctatctatctatagttgagacaaggtcttactctaacagccaggctggagcgcagtggggtgatcacggctcacagcagactccatctcccaggctcaaatgatcctctcacctcagcctcccgagtagctagaactacaagtgcaccccactgcatgtagataaatttaattttttttttttttttttttgtagagacagggtctcactgtgttgcccaagctgtcccctaactcctgggcttaagcaatcctcctacctcagcctcccaaagtgctgggattatagacataagtcaccatgcctggacacatgtgatattttgtatgtatgtatgtatgtatgtatgtatgtatgtatgtatgtatctatctatctatctatccatccatcgatctaaaaatttaaatatagttttcgaaatgttgtctctcattttttttttccgtacatgggcttcttattaacaataaataaagtagctaaaaacaacgaactaagaacttcagcataaagctcaatgggtgttcccattcattgcattgtgaagttgatatgaatgccattttgatgctacctcattttctggctcctgatgaagaaacagattaatgacaaattcctttcattactaatttctgtggttctcatgaagtttatgacattttaatttaattttattttgttacttttctaatccactactttatggacaagtcaacaaatggtttcttaaaagtacctctctactaggaagttggcaataaatacaaataactaactgttgctgtgtggatacagcctcccaacgggagacaacaggggagtcaggggagtgaagaagaaaggaagaagtatgatttgtattttgtttttgttcataatttttggtgttgagtacaaagtttgacccaagacataaataaatgcgttgatttttgaaaactttaaataaaggtatcttattctgtggttcaagaaccactggaaatgtagaggtcatccaaatgtcctgaaattggatgcaaatttttatttctatgtgcatatgtacatttttatggggaaaggatacacgacattattcagattttcctcaacatataagactagcaaataggttcaggaccactgccttatctattaattatattcaggtccaaatgggaaaaagacgtttctaagaaacaagaatataaatgccttaatccatgaatttacttttatttatacaagatattacataaaataatctgaaacaaagcatcttccaaaatagtgttataagaatgaatattatgccgggcacggtggctcatgcctgtaatcccagcgatttgggaggctgaggcaggtagatcacctgaggtcaggagttcgagaccagcctggccaacatggcaaaaccccgtttttactgaaaatacaaaaaaattacccgggcgtggtggcgtgtgcctcaaaaaaattactgaggcaggagagtagcttgaaaccgggaggctgaggttgcagtgagtcgagatcatgccgctgcactccagcctggacaacagagtgagactccatctcaaaaaaaaaaggaatgaatattataatactatgttatttacttaattataagaattaaaaatatatttgagcatatttagggcctcataatcatgcatagaggaaattgatatgatccattttatgttgagtaactcattatcattattattattaataatattgcttactacaaaaaattaggcaaattccttttcttataaaaattaagagttgaatatgttgttatgcctaaactacataacgtctgcaaaggttatggtcttatggatgatgatttttctcaaatattagtgtgaaaataacaagtttctaagttttccaaataacttaatgtgaaggcaaaggatttttaagaggttttgattatactcagagagtggaggactaagtgatgaaagaccaagatgagtggtgatctgtgttcctttaactattatgtgcagttgctgacacaaaatggttttgttctttctaaaaggtagagagagaattttgcccacagacagaaagaaaatgtctttcaagaagtggtttgagaggctggagagaagcagattggttacttgattactgagagggccattaataggagctcatttctagctaaagtgctgacatcactttgaagccatttacaattgttaaaaggaagcaaccctttagtataaataatgagcctgttacagtgaagtgcattggcagatattcataaacacagatacaggaggagctgttattcattacaattactgtttttcgtatgtttgaaaaatgcaaatatatgtgtgtgtgtatgtgtgtagtcgcacagtgatattttgttttagtacgtataatttagaattatcaaaaggaggtttgctccttatatgtaggttatattatgtcatgtgtctacttttggagagagtgataaattgagacaaatattccctaagtttggatttaacaacccaaaatcctctaggatgtcactctacactttatttggcaacttttctatgtgcatattttagggacgcttgcagaaaaggtatgtatggacaagacaagatccttgcctagaaacagaaagaacaaatatgagcagaggcataaatcaaaacataagcaatacaaatcagtgctaatttttttaattaaataaggctttctgattcatgatctaacctttaaaagtagtttctgaagtatattctctgttatgaaacttcgttcttataataaaaatcatattttgcaaaaaaaaaaccctaattttcaattacactatgaaaaaataaactaatgagttttcactattaaaaaaataacagaagccaagttcatggagttgctttttctatgtatgtttattgcttgtagtctttcacaaggatacatatattccaagttcaacatctttctttctcttttctttctctttttttctttctttttctttctttctttctgtctttctttctgtctttctgtctttctctttctctctctctctctttctttcttttttttttgatggagtttctttcttgtcgcccaggctggagtgcaatggcaccagctcggcccactgcaacctctgcctcctgggttcaagtgattctcctgcctcagcctcctgtgtagctgggattacaggcatgcaccaccatgccggctaattttgtatttttagtagagatgaggtttctccatattggtcaggctggtcttgaactcccgagctcaggtgttctgtctgcctcagcctcccaaagtgctgggattacaggcatgagccaccacgcccggctaagttcaacatatttcatattcaaaatatctgtgtcagttagctttggctacataataaactactctaaaactgaatggcttaagacaatttagttcactgttctggtaggtgtttcttctggtctgggcttggctctctcatgcatctttggctcaagtatggctttccacagtgtcttaacccttcaaagactcaggttttacatctaaaaccagagttcgagaacaggaacctcataactgacaaaaaaataaaagttactcctcagtgttgtctgaactcatctctcctgctaaactcccaaaggagaattcaaaactggcctattttcctcaagctccctattcaacccttctcaaccttcccctctccttagccaatatcctacctgatatgtttttaaatattttagaccctcagatatgaatgctcttgccttccctatatcctaatgataaatgtattcatgatcacagccaacctcacgttcttttcctggctttctcagaggagagtctcatcgtccacttaagagatacctatttcacttgcatccttgattttatcaattcttattctctttcaactgtatggtcatcttcatcttttcctctctactgtagaactgccattttatttttcttcttttctgagccaatcttctcgagggagtaatctcaattctctatctccatggcttaatttcccacttcatgctaatctactgtaattcagtctttatttgtcatggtgcaaaaactattatttttataatcaatggtgacttttatattggtaaatctagtgaacatgtgctagttttttttttaactaggtctctcttctgcacttgacactgttcattactctgtcttagtctctacacacttgcctcttattatagtattctctgttttctttcctttgtgaacactgtcaacatccttcacaagtttctcttcctgcagtcaccttttggatagaggtgccaccatgcttccgtcccagttcctttactcttcttatcctgcacatcctcttgctgtcttcattccatctccaacccttgcatttccatcagatacttctctggagtggttccatagggatgccagatgcactacctaccaactcatactgaattttttatatatatatatatatatatatatatatatatatatatatatatatatatatatatatatatatatatatccccttcttctttagcacaatatcctggagaatcacgtagattagaaacaaacgggtcactcttgttcccctacttcctcactttcctattcaattagtcatcaagacttgcacattttgacaactaagatttttcttttgttccatcccctttcagcccatcacagtcccctaagaccacctcttagttcaaatattttgtacctcttgtttactaccacagcacacaacagtttcacataacttcacattacatatacactttcactcaaaaaaggatagcatttttggattttgaagcacggcataccttttaacgtgtgtataagatgtgttttctcatgacttcttatacaatcacatgtactattctgcattgctgctttatacgcttgtgacttatctcatgtaggaatggaaagagggtgatccctttccttcccatcataagggtcacagttgacacctctataaaaagagagaagccatacaaatttattttatcatagtttcttgtggcttgggagggagccttcagaatgaagaccccaagatacagggaagactacctttttatgcttaggttccatgaaggatggacagctgtgtagaactgtgattggacaaaaagggtatgatctaatactaatagactgagtgggaaaaatcagcaaggcctgtctgtccagattcttcttgacctctctgtgcagcgttccttcctcccaggtgtggtgcaggaactctctctggtatgggggatctttgacctatagtcaacaggtaagttagagaatttctttatggccagttcttacacataaaggtagggggtaagttatgatgatatttttaggttttatggctggccttgaggagaaacatttctgatttctatgaccagttttagggaagagggattttaatttcgatggctatcctcagggaagaacaaggggtgagagacaaaagggcaggagggcagaattttgtttctgaaattgcctctgaggacttcactttggggtactgcttcctgtgcctcaatataatcaatgtgatcaattttacattgttggtattattcaatgatactttagatttgtgaaattcactagttagaaccaagctatttattctacattaaaacatttcaatagatagaatatcttacaatagctattgtcaaaaaatcattattattgggtttaacatttttatatttagctctgtgtggaatatcttaattattttttgacttctctctcatgtagcatcagaaattattcacttgaacagattttagattaatttattgatattatgattaccatgcatatccattaaatattttgatattgacaattaaaaagaatgaagtatgcatatatgtctcaatcatccagctgatcctaggaaagggatgtgcatttattaatcatgtttttaacccacagcacttactgtgacatttgtcacatagtaagcactatatatgtttttaaattaatgaagctatcaaagttcaccaaccaatataatttcagaggacagatgaaggctttcacgtcttcatttgttcacaccctatattcttccttatgcagctatttaaaattaattggcaagaattaccactctccttttctcatacttgttttggattctaaactttgttattttatttttgccatctctattctttctacttacttgacaattttaaaatcacacattatctaaaatcaggcagtgttttaattggttgatatattttacaagaaaccattccaccattatgttcttggtgatttaaatgcctatttggctacttacttgcacattatttgcaagaatactgatatctctttgaaatccttatctgtgagtgtgttagtccatttgtgttgctctaaaggaacacctgaggctggataatttataagaaaaaaagtttgttttggctcacagttctgcaggctgtgcaagaagcacggtgctggcatctgctactagtgagggcctcaggaagtttctgatcatggcagaaggtgaagggggagccagtgcatcacgtggttaagagaggaagaatgagggagaaagagtggggaggtgccacagttttaaacaaccagatctcacatgaactgagagtgaggactcattcattattctgagtacagcaccaagccattcatgagggatctgtttccatgacacaaacacctaccactaggccccatctccaacattgaagactatatttcaccataagatttggaggggacaaacatccgaactatcagcaattatgtagctacatagaaacaccaaagctgttctttctattttatttggtagaggttaagataagagaatatgacagtttatttcactcaaggcattttattaattcattgacatttgtctttgaacaaagagggtcatgtacgttcctgccttattcatggtgaattggtttggatgtaatggtacttgtacaacctgaggtcttaccaaggatactatctctccagttcatttgtatgtctttccaaggactctgaaacattttgtccaaggaaaaagtttcttattgaatttgaacttacatcaaatgaggcaaagtacttagcagccactccactttcagcataggaaaattctataatttgtcttgtgcattgtatgcattgttctatttagaatctgtgtttaccttgtaaatgtacttttaataatacctgaaaaagtaatattgagaatgcattgttctatgtcatagccctcattatttcattaaatgaagagctgaaaaagagataatcatttaatttatgttttaaatatctatactgacttgtttgaagaataatatagccaccatttattaaaccttggaagtagtgattttacaaacatttttttctcattcgcacaatgactctgcacataagtggcctattattattttcattgtccagttgacgattcaagggttatacaatttatgtgacttcccattgtcatattggggctggaatctataccaattttgcagaacttgagaatttatgtcctttcctgtataaccgtggttttccatgttttccttctgcttccatatttccacatgggcaacacattcccactcttttacataatatttcttcagaaaaaggcaagaagaaggttgtatgtaatctgaattggctgtcttttacattcccctctcaaaccctagaggttgcaatacccatgatcctcttgagaattgccacactatatagcagtggttggatgctggctccaaattagaatctctaatagtctgatttaattattctgggtactaagatgctggtattttaagagctctctaggtgatttaatatgcagccagagttgaaaaccaaggtttcccttctattgtatttcatgaaatgaaaaagacaaaataaaaaaagaaattcaatttatattgtttgctgtcaatgaaacatatcacataacctcccaattcttaaattacaccagtacttcatatttgaaatatatattcttaataaatcttttaactttcagggctctttccccctaattcttttcagttactttattagctctttgaccttgggcaactttctcttagagtcgattttcttttcttcattctaatttataaattaaactcttagctaggtaatattatttattacttttttgaataggtgactcttataaaatttcatttattttgtttctggtatttacatattggcctagtgaccatactagatacttaatatgctgtatatattttatacacataaataaaaatgtaaatacacactatatatatactatatttatttttagagtaaataaactttttaaacttcaggttatttagcactaacatactctctgatggtcccagtattaacatggtttttaggagtgcacaaacccttttctgcaagagaccagagagtaaatattttaggctttgtaaaacttatggtctcttttgcaacaattcagtatctgtcacaactattcgactccaccattggaatgctaaagcatctgtagacaatatgtaaacaaataggtatgattatgttgcaataaaactatatttatgaatgctagctgtaggctaggtttgacctgcagtctgtcgtttgttgaaccctgctttttatgatgattgtgaccttgattttgttttcctttttcatagcaggtgcttcataagtattgatttatattagtatgtttcctactttcttcctgccacaacacagcagttgttcacaggaattttgttgcttctcctagccttttccataattttttggtattaaccaaagtaatctactatatatggagaaatttgctatggtattacttttgtataggttatgtggtcagctgctctaggttgattattttagctctattgaaatcactttggtagatctaggctgcagcaacaaggtgaaataaagttagaacaatggaaagagtggtaaataaaaggatcaaggccaatgaaaaggcttatataagaagatatcccaaaatattagagttttttagtggctctccctattatacacactgtaccaattaaaataaatttaagagacttcagaagaataacacagttttcagatgggtggatatggacatattctccaatcctcaggtgactacaagtaagaaatccactaattggaaagaaaagaaagtagactgtaatataacaggtaacaacttcatgaaatgagtaatctcaatgagtagtttagactaaaaatacaaataaattatatatgtatatatatatagagagagagagagagagagagagacagagagagagagggagagagagagttcataaatgaataattgtagaaagttggtttgagatttcagtaataacgtcatggagggcagctctgttcatttttcagaatgctctattcaaagtagttatgtctgtgattttatttatactgtgattttttcttaaatgttttgatttctcttaaagtcgtatgcttttcctctcattatttaaatttagatcacggtagtatgatttactattaaaaggttaataaaatgggctgatatttctcattatatatgagatagcttcaaattatgatatagaaaagccattacattgatatagagcattttctgttttatctaacacagaaatttcccaatcacttaatctgcttaatatttatagatcttacattatccatgattactgtttcagcttatttttactttattcatgttgtgaatagatagtacatgctcatggtacaagattctaaacacacacacatacacacactcaaacacacacacacacacaaatgatacagagaaacagtagtctcttttttcttctgtccgtctatatcctgaattcaattactactatgagtctcatctagaaatagttcatatacttacaaacatatttaaattcttatgtaatcccatttgacccagcaattccactcttaggtatatacccaagagaaatgaaaatacatgttcacataaaatcttgtgcacaaacgttcatagcattattcataatagtcaaaagtggaaacaacccaaatattcatcagctgatgaatggataaaacaaaacgtggcctatctttacaatggagtataattaggcaataaaaaatgaactactggcttggcgcagtggctcactcctgtaatcccagcacttcgggaggctgaggcgggcagattatttgaggtcaggagtttgagaccagcctggccaacagggagaaactccatctctactaaaaatacaaaaattagccggtcgtggtggcacacgcctgtagacccagatactcgggaggctgaggcaggagaatcgcttgaacccaggaggcgaaggttgcagtgagccaagattgcaccattgcactccagcctgggcaacaagtatgaaactccgtcttaaaaaaaaaaaaaaaaacaactactgatacatgttacaacattgctgacccttgaaaacattatgctgagctaaagaaggcagctattattaaaagaccacatattattcaatttatgtgaaatgttcagaacaagcaactctatatagagaaaaattactgttacagggctgctgctggtggtggtggagggtgatgcaggaaaggggaaaatgggagtgactggtaataggtaagaggtttcttttggggagggtgaaatgctctgcaattacatggtagtggtggttggacaaccctgtaaatatactaaaaacactgaattatacactttaaatggatgaatgatatggtatatgaattatatctcattaaagctgttttaaaaaatgtatatttgttcaagattttgaaccagcaacatctgtaacatattcaaatgcaatttcattttagcttccaagcatggtcactctacctcataggtgttaattcagtattagaatgactagtccaaggtagcatctaaaactctgaacttaatttagtgttaaattgtgccccttccccggtttagggctactgcagacaggagtattacaacagaaaagacaggcgtggcaggcggcgtctttaaatctgttccttggacttctctcctgcttacaccttgctattctgactgttccaaggtcagagcagaataaagacagaatgaggtgatataaagtgttttctaggcctaatggctggttaagtgttctttctctttgtctctcccctcccagccctacctacctctcctacagtttccttgacccagacaggctcaatctctatctgtgtggagacttgttactctttccttctcttctgaagatctaggcttcacctcaggttcttgttgctgaggttcttatactcccataggtggctactggtcagaacccaagtcaacccagtgttgactctattttctgtgtactttgctgttagggtgcccgtgtaagttatcatccaaactgaaatacatttgtgagtgaaagggggtattactaataattttgatgaggccgggagtggtggctcacgtctgtaatcccagcactttgggaggccaaggcgggcagatcacctgaggtcaggagtttgagaccagcctggccaacatggtgaaaccccatctctactaaaaatgcaaaaattagctgggtgtggtggcacacgcttgtaatcccagctactcgggaggttgaggcgggagaatcgcttcaacccaggaggcggaggttgcagtgagctgagattgcaccattgcactccagcctgggtgtgacagagcgaaactccgtctaaaaaataaaaaaataataattttgatgagacaggcataaaatgggactgttctgagcaaatgggtcttatagatacccactgtatagaaaatactcacatatcctttgcccccaaaggtttggaacactgcctcatctattctgcttgtggccattgctctgcctctctcaggtgtgaggtgagctccattcctccacatcacccaactgcaaagaacacattcagtagatttcaaaggaatctcatagaagacccctttacttggctggagataatagatgagaattctcagctctttcccaaggagatagacaaaatatcttgtcagagaaatatctgcacaaaatccttcctctgcactttcctaaaccatttaaaatctgaaagtcaccaaggagttcaagagtaaggaacagatgcttacccatttcctttaaaaatctctatttagtgatttgtaactcacactagtatttcgcatctgttgtaacatggtgcctagttccaacttcaattttaacatcttattctgtatatattctttttttgtccacacaaatgtgagagttatttttgaaatataatgtcaaaagagatgatttgtcttagtggttcagtgtggcacaggctttgaaatcagaaaaccagtgttattagatttttgactttaggaaagtaacttgacttcttgcagccttaacttcatccccagtaaaatgaggataataatagtacctacctcatgggactattatcataattataagaaatcacatatgtaaagaaattaacataatactcaacttgtggtttgatgtgcaataagttaactattattattactatgattgttatttttaatatctataggaaaccaaataatatgaaatgtcacaaattatttttgaaaatactattctaaggtcttttttttttttttttttttttttttagattctatatcaatttttattccttcattgttacgaaacagatgaataatccttggcagatatacttgagagaagactcttctctcttcctgactggggtccaagtagtcctaatcccatttatccgcatctgtatattccacattggatttgtctcacacatgtccttcttgagatgttacttctgtgtttgagccagattctctgtctagaaaattgtccttggttatacctgctcaatgtttgctattaataatgatatacatcataatcatttaaaaagcccaaaactataacaaccctttagattaaagatacatgctccattggcagccctcaagccatttattttcacaatgtgctgagtttaactcactcattcatttataaattgacttggttgccaatatttggaatcagaagatgtttatcccaaatccagctttccatgggaaatcaggtaacatgggagaacttggcccatattttatttatttatttatttatttatttatttatttatttattttatttttttttttttattgatcattcttgggtgtttctcgcagagggggatttggcagggtcataggacaatagtggagggaaggtcagcagataaacaagtgagcaaaggtctctggttttcctaggcagaggaccctgcggccttccgcagtgtttgtgtccctgggtacttaagattagggagtggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaagaatttttcttagtacagaacaaaatgaaaagtctcccatgtctacttctatccacacagacccggcaaccatccgatttctcaatttttttccccacccttcccgcctttctattccacaaaaccgccattgtcatcatggcccatccccaatgagccgctgggcacacctcccagacggggtcgtggccgggcagaggggctcctcacttcccagtaggggcggccgggcagaagcgcccctcacctcccggatggggcagctggccgggcggggggctgaccccccccaccatcctcccggacggggcggttggccaggcagaggggctcctcacttcccagtaggggcggccgggcagaggcgcccctcacctcctggatagggcggctggccgggcggggggctgacccccccacctccctcccggacggggcggctggccgggcagaggggctcctcacttcccagtaggggcggccgggcagaggcgcccctcacctcccggacggggcggctggccaggcggggggctgatccccccacctccctccaggatggggcggctggccaggcggggggctgacccccccacctccctcccagacggggcggctggccgggcagaggggctcctcacttcccagtaggggcggccgggcagaggcgcccctcacctcccggactgggtggctggccgggcggggggctgacccccccacctccctcccggacggggcggctggccgggtgggggctgaccccccccacctccctcccggacagggcggctggccgacccccccccccgcctccctcccggacggggcggctggccgggcagaggggctcctcacttcccagtaggggcggccgggcagaggcgcccctcacctcccggacggggcggctggccaggcggggggctgatccccccacctccctcccggacggggcggctggccgggcggggggctgacccccccacctccctcccggacggggcggctggccgggcggggggctgatccccccacctccctcccggactgggcggctggccgggcggggggctgaccgccccacctccctcccggacggggcggctggccgggcagaggggtcctcacttcctagtaggggcggccgggcagaggcgcccctcacctcccggacggggcggccggccgggcggggggctgacccccccacctccctcccggacggggcggctggccgggcagaggggctcctcacttcccagtaggggaggccgggcagaggcgcccctcacctcccggactgggtggctggccgggcggggggctgacccccccacctccctcctggacggggcgactggccgggcagaggggctcctcacttcccagtaggggcggccgggcagaggagcccctcacctcccggacggggcggctggccgggcggggggctgaccccccccacctccctcccggacggggtggctgccgggcggagacgctcctcacttcccagacggggtggctgccggacggaggggctcctcacttctcagacggggcggttgccaggcagagggtttcctcacttctcagacggggcggccgggcagagacgctcctcacctcccagacagggttgcggcccagcagaggcgctcctcacatcccagacagggcggcggggcagaggtgctccccacatctcagacgatgggcggccgggcagagacgctcctcacttcctagatgggatggcggccgggcagagacgctcctcactttccagactgtgcagccaggcagagaggctcctcatatcccagacgatggggggccaggcagagacgctcctcacttcccagacgggttggcggctgggcagaggctgcaatctcggcactttggggggccaatgcaggcggctgggaggtggaggttgtagcgagccgagatcacgccactgcactccagcctgggcaccattgagcactgagtgaacgagactccgtctgcaatcccggcacctcgggaggccgaggctggcggatcactcgcggttaggagctggagaccagcccggccaacacagcaaaaccccgtctccaccaaaaaaaaaacgaaaaccagtcaggcgtggcgtcgcaggcactcggcaggctgaggcaggagaatcaggcagggaggttgcagtgagccgagatggcagcagtaccgtccagctttggctcggcatcagagggagaccgtggagggagacggagacggagacggagaggggagaggggagaggggagaggggagaggggagaggggagaggggagaggggagaggggagagggagagctattctaaggtctttagaagcaaacagtgccattgagaattcctcaaagcactaaattacaaaaatattcacatagatttaaaggttaaacctggcttatagcaggtactcaactaatattgaatgaattaaatgaaacaactctttatctatcaggtacctttacaaagtgtacactaccattatgttataatgtattagtctcctgagtctgttgtaaaaagttaccacaaacttggtgacttaaaacaacagaaatgtattctgtcatggatctggaggccacaattccaatatatgttagaaccgcagcttattagaggaaataagcaagtcagaatgcttgactgtacatatcattctaaactgatagacttgacctgaggcctttgacctcttacggaacaaaggacaagtactttgtgacagctatttttctattttattatttgcctatatttgaaagcacatttaaatgatagatgttgaatttgttagaaaagtgtcagtctttaacttttgaaaaaatgccagttaataaaaaggatatataggtatcaagtatccttgattgtgttgtatttaaaaacagtcgtgcgtatgtaaatagttccaaaaatatgtgatagctacagactttttggttgtttatggaaatatatctcaattatagctgttttttataagcctgaccatcatagccaatcactggtattaaaaaaatatatatgtatattatacgtatatattttatatacataaatatacatatatacatatatatctataccttatatacctatattattattctgctttttggtagaaaaggtgtgtgtgtatatatatatatatgtacacacatacacctttaatatatcatatgtatatatacctttaatatattacatatatatgccatatatatatatatatatatatgcaccgttttggggtgtgtgtgtgtgtgtgtgtgtgtgtgtgtgtgtgtgtgtgtgtatatctatgtatatatatacctgatatacctgtatcattctgctttttgaccttatctttgaaaaactttgtcttcttttgtttttaaggatattcacaagaatatgaatagttcgaaatgtaaaatacaaactgctgtagggtagaaaaaactgtagtgccttttcctcagggattccaagcgttgtggccaacactcctatgccaaaagacgttaataagataaaagcataacagaattaatcaaggtattttgtgacatggaaggcttcagaaatgaagacccgaagacccagggaaaactgtatttctgtgcttaagttcgatgaagcatagacaggtgtggagaaatgtgattagacaaaagggtatgatctagtgttaccagattgaggggggaaatccagtgaggcatgtttgttcagattcttctggcctctttgtgcagcattctttcctccaggtacagggcaagacacctgtcacatgtgggttttcaggggagaacagagaaggtcagagagtgacatttcttggttttatggcttgctttgggggagaggagttctagtttctatgacttacctgagagtgtgggtggagaggaattctggtttctatgtcacactttggaggagaaaggggagccggagactggagggtgggagaaggtctgatagacctgcttctaaggtccccccagtctcctccaagtcaaagtactcagcatacaaaggtgccatactttggggtattgtgttctgagttccaacatggcaaacatgcccttttattataaaatggctttggacattttactgcattgccttaaaaaataaccaaggaaatgtgccaacatttataaaatatatgtgtaaataattatatgcattttaatgtttctatcaaaatatagactagtatagataggttttgagtttatcagttgaacactgtcaatcttaaattttaagctgactgtggactattttatcttaaagcattgtctaagagataaaagagtatacatttacaagattactttctaatttaaagggaaaaaagattagtattctcaactttaaatgaaaatcagtagcagtgaggaaatatagtactagctaaaataggcgtcttgcagctcatgacccttgagtttatgcttattatatatgtgaccttagagaagtacctttacctcagttaacttcaatgtccccatctgaaaaataggagttgtgataatgatatatgaattacaagattttttttctgtattaaataagatactatacacaaagggcttaaaacaatatctgacaaatttatttatttattttttttgagatggagtctcactctgtcacccaggctggagtgcagtggcttgatcttggctcactgaaacctctgcctcctgggtttaagtgattctcctgcttcagcttcctgagtagcttggattacaggtgcccgtcaccacgcccggctaatttttgtatttttaggagagacagagtttcaccatgttggccaggctggtctcgaactcctgacctcaagtgatctgcccgccttggcctcccaaagtgatggtattacaggcgtgagccactgcacctggccgacaaatttattcttattattatgcatcatattaaaaattaggctttttaaattttttggtatgcgtcattctctggactgagcatcttaaggacatagaaaccatatcttaatcattttttattgtggcttcatcaattaacactattttatccttaaatgcttgaataaatgattcactgattgagtgaattgtcggctgagttaactataaagtgtgtgagaggcatataaatttaatcactttaggaaatttttagtttcagtattatatgggaaatggcacacacacacatacacacacacacacgcacattgctgagccaaatacatttgaacatagaatgctctatttataatgaatctaaaagtgttaaattatacgtttgattcttttcatttctaagaaggttttgtagatattattaaatctttgtttacgtagttgttaaatatttgcttttaattttagacaacaattggctgaaagaaaagctcatgttatttttaaaaatgttgctttttaacacacatttcctatattacaactctctgagggacaagtgacagaaatctaactgaaaatagttcaaagaaaaatactgactcagtcagtgagcactccagtggtaggactgtcattgtcctcagataaagttgaatccgggagctcagttgatattattagtactttgtttctctctctctgtgtcactctccctcatccccttcttctcttcctgtctctgtctgtctctccatttcttaactgttcatttctctgagtccctgtggtaactttattatctgtgaggccctatctttctggtgattaaaatggcctctggctacctcagacttacatgattcttggtgccccccattttagaaagctccacatttttgtttggtctgattttgatgacatgctttgatcacacgcccacgctggaatcaaccctagtggctaaggggatatgttaccctgattggccagtcttgggtcatatgcccagcactaagataaataatatgttcggcccacccgagccgcaggtactgagaactgtgatctgttctccaagcttatgctgggtaaatacacacacacacacacacacacacacacacacacacacgcacacactcaaatatcacatgttactatgttgatgacactgtgataaaaattggacaagtcttttataagaaaggcaacttgacatattggaaaaatgtaggaggcagatcattttcactcctgtacattttggctatttgctgtcatcagccaagttatataacctttctgagcatcaattacttcactgtaaacataggatagattgtgatgaaaattaaatgatacattatgtaaagaacctaacctagtacttagcacatagtagataatcaatgtatattaaatgtgtaatcactctttgataaaaataccttaggattcagaaaagggaattgaaaagtggggaaggggtatgaaatttaaagaaatactatctgttccctttataaaaaataaactttttaaagaactattctagatatgcagtattattatagttagttctttttaaagaactattctagatatgcagtattatacagttagtttctgtataccctacgcttagttttccctgttactaataacttgcaaaagtatggtacagttgtcataattaatgagccaatatatgttactaactaaagtccacattttattcagctttcctcagttttccttaacattcttcttctgttccaggatctcatccagataatcacattacatttaatcatcatatatcaataggctaaccttggctgtgacagtttttcagattttccttgtttttgaggaccctgacagttttgaagagtactcactaggtattttgtaggatgtccctcaactgggatttgtctttatatgtatattttttcatcagatgtttctgggcaaaatataaggtcagagacttgtcagtcaccttcatccctatagcttagctcattatctgttgcatagtaggtgctgaatacatgtttttctgccaactgaaagaatagatacagtggtagagattactgtttatctagtcaatattctttgtttccttctgccttactgacaagaacatactttaaaaatatatactcaattgtttgttgattgaggtgaaatttgtataacataaaatcagtcattttaaagtgaaacattcagtggcatttagaacattcacagcgctgggcaactaccatctctatctagttccagaatattttcatctacccaggagaagttgctgtacccattaagcaggtgtgttccccatctctcccacttcccctacccccagctcttggcaattaccaatctacattctgtttctacagatttacctattctttatatttaatataaatgaattcacacaatatgtgactttttgtgtctggcttctttcacttagcataatctttttgatgttcatccgcattctgtcgtgtatcaacatttcatttctttttataataaaagcctaattttttttggaatagcaatgaccaagtttaaaactacattccctttcctttggtcgtgtggcactgatgccaccaatgatgtctaggaatcccgataaggcctctaggcaattttcttacagacagctggttcagcctgcaagtaccctgtttgctcttttcccttttccttcttcctttctgaaatacaggtattatggtgagagctatagatctaagcaacataacacaaggatgatggagtgaaaaggtgaaggagctggagtctccgaggacaccatgtagctgccataccagccctgtaatgactactttagccttcattcatgtgaaagagaaatgaacatctagtgcccttaaaaatattagtatagcaattcagattttactatgcattagaaatccagtgaaagctagagacatttcctggccaatgggtttatcataattctgaattaacctatgtaagagaatattcaaatgtccactgaaatcaatgttctaattattattgcccttgtcacccttagcttactattcctgtgttcctagtatggcagaatgaaaaaggctaaaacgttatatctgaaattggaggttgctgacctgtaaaatgagttagttagacaacaatataccattataactccatcttaacacatgttaccacccccttctggaaaataaatccaagatgtctgtagcacctttgtagccctgacggaagagtcaggccctttgtgttgcctgcacattcacttaggagagaatgaagcgtgctaatttgtggagcatataatctattcttttattaaaagtgtatgacaaatggatacagagatacctacctggcatactcatttgcatactaaaaatataatctttatagaagacaaaatagaatacgtccttgagcaaaacagagggaacaatttagtgttggaatggctaagaggttggaataatgatgactaaacttgaaagtgaagatgaaaaagttgagtctgaagggcaatgaaaagccagtgaggatttttaaaaataatagtgtagttggagcaaaggaggaaaaagttattttggtagaaggaacattttctattacgtgaggaaggtaaactaatgaggagactggagcatggagtatgctaatatgtgaatgaaaatagtgagtacattgagagcaaccttaggattgaaaataagcttaaaaatgaaaaaatgaattaatatactgatgtaccgtgattgctttgctttgattctttttttaatttttgagacagagtctcactctctcacccaggctggagtgcagtgggatgatctcggctcacggcaacctctgcctcccgggttcaagagattctcctacctcagcctcctgattagctgggactacaggtgcacctgctaccacgtacggctaatttttatatttttactagagacggggtttcaccatgttggccaggctggtcttgaactcctgacctcgtgatccacccacctcggcctcccaaagtgctgggattacaggcgtgagccactgcacacggccttgttttgtgtgtgtgtgtgtgtgtgtgtgtgtgtgtgtgtgtgtgtgtttgttttgttttgtttgtttgtttttgtaattttagcttcaggaaaaactttctgaggcaaaaaagttaattgggacttaaaaccaaagaccagaataagtcattcatttgaatacatttattgagaatttactatattccaggactctgctaggcattggagattaaattgtgaattaaaaaataaggcttttacccccattgatcttaggttttagtgaaggaaagacagtaaacagataacaagtaaatacttaaagagacagttaatagtgtcacagtttttccaattttagttccatttagcagtaaaaacagaataaaatgaagccacatgtaattggaagagagaggtcaagcatgtaacttttcttgaagatgaatcattcaacaagcatgtttgcatctggtcattagtgatgcgtttgggcagctttgccctcactgtcctcagtcacaagaaaggatggacatgagcagaggaccctgtagaaaaaggcagacatacatgacaatatgaagtatcacttggttgcttttctaattatttatcagtttttaaattgtaaatatgacttagactgcaggctagtatcacctgaattgtctaattatgctaacacgctactaaaaattacgatgttgataatgtgtttctctttaagttcaagtaaacatcattaaaagaagcacaaagcaagtgaaatatgcatggcagagaagcagtataataagggaccattgctaggtcacaggttccaatgttaacagcgaatgaagccgttttcttttttttctggaatagaatttcaagtagatgatgactgaaaagtcgttcttggacagttcagcctcattacttctggaggtctctctcatcagtgcctagtggagatgacaattcctaaactgtctgcaacaagtattaattacttgggtaatcaaaacaatataattgttgatttcttccctgtatttattttataaaatgaaaacagctttaactgtttttctggctgttaaaatacaagctccttggaaaaacctgtaaatgaatagtcaaattatcaataatggttttctcccatggtgagattgtaggtacttttgctttcttgtatttattttccatatttttgttcccagtgagtcccacagggagaagctgagatgccataaaggaaaaattggggctcatgagcaaatagggtaaggacccagaagtggtacaggcctaatggttccctgctttttgttttagcccaggtatccccctttccttgggctaatgtagatgagtcttttcctttgcccccaaagaaccctgctaaaaccgggtggggctacattctacacttgtatttattggtcatcattccacagaaccaagcacacagtagaaactcaagaaataaaatacttgattttattaagtgtcttatttcctgaaagtatgaaataacattacgtggtggagatatggttaaaaacaatatgatcaatttcaggagaaggaaacactccataaagtgcgagtcaacttgatgatattctatgagaaaagattgatttgtagtttttttttacattagaaatctcatatatgtgtctttgtgtgcaatatttatttaaataaaggctaaagattcccaaaaacattagtgagaaactcttcttaattagctttcacttcttggcccacattagtctttctctctctcactttctcacacacatacacacacaccacacacaaatgtaggtaggagagcaagggaggaattccgcattaggacatatcgaaagtagattaatgcaaatgaacaagatgccaagtacagtatgaaaattgacatttatcagcacactctgtatgaagatattttcaaagctttgccatacatatgaaaatattccatttttatgcttatgttttcgttattcaatagcatgcattactttctgttgtttccaaatgcaagttgtaaatctcctcagaaaatttcaccgatgtgagatttcacttagtcttttatggttgggtggatcatttcctttcaaccagaacagtaattccatgtaaaagagtaagaataaattgaaatagaaagccatgttgctttgaaattgaaaaagaaataaattattaattttagtggctttttggccatacttaagttcctattttcatctatggaattatattttaacatcataaacatgaactatgttttatgttcacagaaaagggaaattttcatctagctattcattttacatagctatttgccttgattcactttccttttttaaagtatttataaatttcatacatttttaattagacaaatgatacacacatccattcctattatttaagaaaagtaaaaaaataaaacacacacagggaacatcttaatctcccttggccattactcactctactctccaacttctccagaggtaaccatgttttttttgtttttgtttttgtttttttgaaacagagtctcgctctgtcacccaggctgaagtgcaatggtgcgatcttggctcactgcaacctccacctccctggttcaagcgattctcctgtctcagcctccccagtagctgggactacaggcacatgccaccacgcccagctaatttttgtatttttaatagaggcagggtttcaccatatcggccaggatggtctcgaactcctgacctcgtgatctgcccgccttggcctcccaaagtgttgggattacaggcgtgagccaccacgcctggccaaccatgttttaagaccaggacacgaccaatcagacatttttaatggaaacttgatggattgtttcgtagatcatctttttaactgacagagtatttcacgcttaaactacacaaaagttacatttaatcgtttccttattggtagatatttagaattatccaaatgtttcaccattacaaataatgcttcagttataatccatgaatatgcctcattgtacacataagcaagtatttctctgggataggcactaagaagagaaactgagagtcaaagggtacaggcatcatgaattttaatagatactgccaaattgccctccaaatgtcagtatcgatttattttctcaccagtaggatatgagaattcacagcccctctatcttttggaagcactgagaagagaaaatgctattgacatgttgttgtaatatgcatttctctgatttctcacaagctctggttttcatattcttagtgtctattttgtcttccttctctctgaaatgcccattgataacatttctccatttttgtattggtttgttttatttttcattgatttatagataatattttgtaaattgttcattttaattttgttggattttatatcttgcagatatagtatcttatttatcttctttttactttgcttaggttgttgaaaattcttaaatgtttacaggttaaatgtatcaatctttgtctcatgttttttccccttgctgtgttatttaagaaagccagtatcagactctaaactctggtacatttataggtttttaataaaagcaacttgatttataatccatctagcatttattttgtgaatagtctatgatagaaattgatatatatatatatgtttgtacaaacatgaataatatatgacagtttttcttttaattattaaatcaccttacaaatcaaacaactatggaatattattagcttaactacctgggtgattagcaaaagttttatatttcctttccctatactttttaatatctactctaaaataggaaagttactttctctggctttgagttgtcactaaaatatattcctttttgtttgttaaggccagtcagttcttcgatttgaagcccaaaaggctccaatgaggaaaagattcatttcttctctctttggtgctgttgttaatatcctcactcagatgcagtcaggaatatagtaatgcctgtctcccttataaggaccattatgattacattgggctgatctggctaaacctggataatcttctcatctaaagatccctaatgtaatcacatcaacaatctcccatttgccatgtaaggtaaaacactcacaaatactggggtttagcatgtggacatctttgggaggccattattcttccctccacattgtcaacctctggtccaactcacttgtcatcagtgtaggagtgcctgtggaggcaggtagagtggtaggagttgggaggattcttgattgccttcagctgagcttgaacctgtgctcttagtggagcagtttcatttaaaaggggatgtggctaagcaggcaccataaaatgtacttctagtagcatccctgaattgaaagagtttacatataagactgcatgataaaattaaatgagttacattttgtaaagcaggtagaacaatgcctgagcagagtaggcatcatatacgtatttgtgcttgttaaataaaacccaaaaataatttccacgaggaaaggagtttcaagcagataattaatttgcgaatgtgatatatcctcttgatccagggagctaattgattttgtgaattacatttctcagggtacactaaatcctcactgttggctatcaagaggaaatacaccttgacaggtttctccagtggtggtgaagattgtgtatggattatacacttaattgtcacatttttaatgagaataacagcttaaaatcaagagtgaaacatatacgctgaaaaatggcagtattaattagctcattccatatttattgaacaactacactgtaccagattttacagagcatcagtgataaataacagtccttgtgctcaagccttttgaagtataatagggtgaattcttttgggtttgcaaatacagtctcccccaccccttatttgtaggagataggttctaagacctaccttacccgaccctgtggatgcctgaaaccatggatagtactgaacctgattttgtcaaatggaacatgttttttatcatgtcttccacccacaaatttaatgccttttccatcttaactaagaacttatatactgtggctgtaacttttgcagttagaggtgcaactgcaaaactagcatgcatttctttttctttcttcacaatttctcagatagaaaatttcttcttactgtagatcttagcaaacagtatatggtgattttttttctttcttttcttttctttttttttttttggagagagagggtctctctctatcacccaggctggagtgcagtagcatgatgatggctcactacagcctcaacctccccagctcaagcaatcctcccacatcagcctcccaagtagctgggaccacaggcacatgtcaccacacccagctatttttaaaatttttttgtagttacggggtttccctgtgttgtcctggctggtctcaaactcctgggctcaaccagtcctcccaccttagcttcccaaagtgttgggattacagatgtgagctaccatgtccagccgtttacttattaagttgagaatttttactttttcacttaaaggaagcactttatggcttctctttggcatatccaaattgccagcataactattcttgcattttgggaccctgattaagtaaaatagaggttacttgagcactagcactgtaataccaagacagttaatctgatcaccatgagggctactaagtggctaatgggcaggtagcatgtacagtgaggacacactggacaaaggcatggttcatgttttgggcagaccagagctggacagcatgagatttcatcacaatactcagagcagtgtgcaattgaaaacttaagaattgcttatttcttgaatttcccatttaatattgttggacctctgttgactgtgggcaactaaaaccacagaaagcaaaactgcacgtaagggggactactatacttataatacaaaatgaattacactgtggcccgaagaaaatattaaaacaaagtggtataaagtattataaattagagtaatcactcttgtaaagatgtcttagagtaacaaggtagtatttgaaatgagctttgaccataaaggtgaaaatgagatgggacaccccaggtaaggggttaatattacctaagatagagagagagaaaatccaaacctttaaaataaaacagcttggcagaaatagaggatgttgcacctataattgtagtgagaaagaaaatggaagagttcaatgtaacttttggatcatatctgggtgtaaggagttaacaactcattaacaagtggcctaagtgacaaatagtgaaagctttgactaagatagtaagaatgaactagaaaggaggggctgggtatgagagacattgtgttaaagcagaatccacatgatttagcaactgatttaggaggggagagaggggcccataatgactgctttcctgcttggatgactagaataatgtagtttcagaatagaaacaggaaattggacagatgatgtattcttgtctttaaatgaatggatttaagatgctggaagaattttgagggtgactctttcaaacaagtatttgaaaatgaggttggacattcctgagggagatagagaaagatatttgggagctttagtctaaaataatctcaaaatgggagaggggagactttgtagctcattttgtcctatggactcatcttacttgagttccagccctttccttgtaactgccaaatgtttttctatcctgatttgaactttgagtctatggaggccaaacccgtggccccctggaggttacctcaaaatcactgacatgaggcaaattgatgagtgggataaatggcatacaaatttatttaacttgtatatacgggagccttcagaatgaagacccaaagacacaggggaaattgtccatttttctgcttagattcaacaaagtatagacagccacgcagaaatatgactggacaaaaatgatatgatctaatgctgatagattgagtggggaaacccagcaaggcccatctgtctagattcttcttggcctctctgttcatgtatttcttccttgtgggtatggatcaggaccctctctggaatggaggtcttctgacctatagtcaaacaaggtaagtgagatcatttctttatggccagtttgtacacagataggacagagagaaagttagagtaatatctttaagtttatgagtggctttgggacaaaaggagttctggcttctatgacctgccttggggaagagggattctagtttctatggccagcctccgtggagaatgggatagagagacaggagggtgggaagaggtcaaagaaaaacttttgcttctgaagctgtttttgaggctttcattttggggcattgttttctgagccccaacgagtctatgacatcctgaggcaggcaattctgtttgtaccattcagtttgaaatttcttctttattctgagttgtctaaagttctttccctttgaacctagttctacatcttgggaccctaccctagagcatttgcggttctgtctcacaaaagctcctctgatgttttaagaaagctataaagtccctctttagcctcctcttccagtaacgcagggagtgtaaatggtgctcagcggcagtataatatcttcatgccctcttttgcttgctccctgctagagttttcccagatataaataaattaatagaaaactaaaaacaacttgcataggttctaggctcaattaatctaacatgtgaaattgaaataaaaatccttcacagaaattaatagggtttcaccatagataaatgcctgagggcatatgtccacctctgtcacctctcccgcttccaatgctcctttattcttttataggctaaacatctctacttggcacaatggttcatgtgacagtttccagtcatatcactgtctttggtctaagtagcatggagaagaacaagaccagcccctcccttggtctacatactgttattttatatatatatatatatatatatatatatatatgctaaaatcagttgtgtgtttggatacacccccccccccacctggctcatagacacactgccaccaatgcctgttaatcatctgcagctcgctatgtaaccaagtggaggttcacccttcactgctattatatttcaccttactatccatcaggtcctcagataacatcgttttgttcaatgttgtttcattataacactgatgagaaaaaaaatcaatccccagccaggaccactgtctatgtggaatttgcatttctctgaatgtccgaatgagttttctctgggtactctgttttcctcccacatccaagatctgtgcatgttcaattcattggtgtgtctgagtggttccagtctgagtgagtgtgtgtgtgtgcgtgtgcatgcgtgcacaccacacacacacccagcgatgggctggcatcctggccacagtagatttctacatggcgccctgagctgctgggataggctcccaccacttgtgactcggaactggaataagcaggtaaatcgtgatttacttattttatgaatctttcttaaatgatgtatagctcatatgtatttcaatgtttaatattagaagtacgttggtctttagaagttttgtgatattttatgacaagaaatatgttacaagaacttaaatcttgtttatatcaattagcctatgagaaaattggttgtgtatgaggttgttgcacctaaagtcgcagtttccaagaacctatagatgacattaagtgaggacttactgtagttgaaccttactctaatctgcacgatcatttagatctcaaattgatcatgtttatcagcttgccttttttctctcttgctaagacattgttgatgatgtagaattttaagaaacttacatttaggatagtgtgcttgacaaaacagtatttttccagtttgacattaagttgtcaaaggtctgataaggaattttgggggaactttattgaagtggtatagatgttaaaagtgctttttaaaatgagatgacacttggtttattctgaatttatttatataaaataacactgtcttacgtgttgagaacttagacttttgattcaaaacacccagcatcaagtcctggtctaccatttatagtttatttatgctccctgaatctatttccttaagtgttatatgaggctattaatgccttcttcctaggctattgtgagggtttgaggagacgatgtgaataaaacacttagtaccttgtttggtatataataagtggctgttatttttctatgaaagtctgattacagtataaaatataactttattccctttgcgttcattttcatgccgaaaggttttctttcaatatgaaattggtatttaattgtataatgaatacttaggaagaaatatcgaatgtacatggtaagccttctaatgttttttgtaagaatggattttgatttgccgtacattcttttcattctttgcgtaagcagcaatacttactgattttgaaggtgataaaggccaaggatgtagtctagaaatccatgggcttggtgttcttaacttttgtgcttttatccaagctgccctaccatcatgatctgtaaccttcaaaatccatccctttttataaacagtattccattacccatttgtcatagcttgcctggagtaaagaaggatactgggaagatagtgggcactcttacttcaatgactgaccccttccccaccatttgttctcatcagctgtttttaatgttccattaaatctctcccttgaagttttgatattatttattatatttttcatttctggaagttcaaataattttgttcaaatcaggtaatctttgtagacagacatagaaatatctgcataagctttatgcttatcttttatttctttaacctacttgttttaaaattgctggctgataactccaatattcatagtttcaccacagagagcaatagctgctctctgctctttcatatgattcttgctgtaggtactgtatttctttttgtgtttagttgttttgttttgtttctatttcaatgagctgatcagtttccctggaatgttatttgtggggattctctgaggcctaggttgaagggaattcttgtagagaggatttccattagccttggcaggtgcctaaggtataaccactctgggatcactataaattaaatgaaattcatagcttgaggttttgggggaccatccaagtaataagaatttgtgctgtaaatctatcttaaggatatataaggggtggagatggtcaagtttagttatgtttcattatttttcctgaggatgtagcccttagctttactgggtagaggttctctccaatttgagatttaaccaagcccccaccccccatccccatctctttagcctcctgctaccattaaacctaggctcagactactggaatgtccaggatcagtgtcctcaggaaaaatgtcttcagtgggccacttaaccctttgagctctgattttacttagattttgggcataggaattcctatcttgtgaactatttgataactttagaaaaaaaaaataacccagtgttgttccttattttcagtggaaaggttgctccaattaaccttgcttgccatattaatagaaatagaacttccctgttatttctcacttaggagttttctcaaccagattttatatttaacatttcaaatttcttggcacaattctcattctctgaccctacttacttgctactggcagctttatttttaaactctgctttagcttttcttttctcctttgtataacttatccttcaacaccttgaaatagttaactcctgtgagtgtaataggaaatttacaaaaaataatctttaaaaaccaccagattatttgattgtgtgatccaggaatgaatgcatgtcttagaagaaagagggcaaattgggtgaaataaaagatgttaagcaagaaactcatgggtggaaagagagtattattgagatgattggcaagaccacttaggctgtcagataattaaatgaagccaagaaggggttatgggaaataagctgattacggcaggtaagacaggaaggaatgatggaagaactggaggaaaaggagcacctattaatcttggggaattttatcatgtattcagatttttaaaaaatcaattaatgaacatttgactatagaccatataaatcagggctgattcatagttttcccttttcttaaaactaattagcagatattagctataacaaaggatcttttgacctcaaaagaatacccttggtacattttctcatcaaactaatacttagaaacaatagggaaacaggaaattaatgagacatctgaaactttatgatttcttttcatctggaaatattagggggaaatcaaataaaatatacattttatcatgctgtttttacatcagacttttcccctagtattctttctcatttggaacatgttaatgtactacaaatgaaagaggatgaaacacttgaaaaatttctggattgtaatatgtttaaaaatatatatagttctccatctctcattttctacatttttccagtgttttttttttttttttaaatttgcttagccacgattcattactcattgaggtcctcctctgtccctggcactatggtaagtgttttgtgttttgcatatagtttctcattgaatcctcagaaaacctatgaggttctaattattattgccattttactggcaaaattgagactcataaaaaataagcaaacaaataaccttattgtttataaagtttacctatatttattttgatgtgcgttttaattgttatcttcatatcaagcctatgattttgtcagatactgttattattttttttaatacatgaggacaaagaagctcagagaagtgaagtgacttgtcaaagcttccagtataccgatacagatggtgctttatctcaaagcttctaagtcacactactaattttctacaatgctacacttatttggaagataaacataggatgatgatgatgttgatgacaatgactacttttaaagtggtacaaagcttgagatttagaaaaccattagtatccaacactagttgtatttggtaatacagattctcctctgctcctcatagtttagtgtagcctaccttaaacatgttcagcacacttatgttagcctacagttgggcaaaatcgcttgacacaaaacctattttatgatctcatgtaatttattgaatatgctacactgtagagtacattatccattgtttatccttgtgatcgtgatggtgtggctgactgggaactatgtctcacttctgctgttcagcattctgacagaagatcacacaaatatcactagcccaggaaaagatcaaaatccaaagttcagaatagtatttctactgaatgtgtattgttttacccatcctaaagttgaagaatcacaagtcaaaccatcataagtccaggattatttgtttatatatcttgtagggaagggaaaagtgaaaggaaataatgttctttctacccttctacattattggctggagcccctgtaacaaaagacaaattaacaagagaaaacaaacaggagtttactaacatgtatatctcatatatacatgggtgatacccaaggaaatgagtaaatctcaaagaggtggcttaagaatcagtcttaaatacgatcttcacctaaaaacaaagaaagaagggtatgggggaaaccacttatgggggtgaccaggaaaagtacagtaaacaagagtaaggttttttatgcagatttaagccatttccttcttcattaataagactccagtcttcttggtacagacagaaagagacacccttacaaatgaaaatttacgttataagtgtgaatttgccttacaaaagggtaacttctactttgtttgcagagcttcacatgtgtctgctatttctcaaaataactagttcaaaataatccttatactgaagaggcatattttggggtatcatattctggtctcctacaatcttaatatcaaatgccatagaaataacccaaaggatgggcacagtgtgtgaaaagttctaggaagaatataacaagtagactatataactactaatggcaatctgtgtcccaaccatttatttagctttatcagatatatttttctgaagatacttttctttctcatgtgctccactggttaaaacccagaaatacttgtagcataaagatataacccacaaacagcaatcatttcttttttcttgggtgtcagaaatagctcctttgtaaattcaggtgtgatgattaaagtaaaaacgagcgtgagataaactgttacgctaattatctggaattctttttgagatttttatgttagattgatttaggtgaggaagtatggcatagggccataaaatcagaggaaaaagaccgtatctgtgagttataaataatttttgtattaaaagggaatattcagtatagtacatctcttcaatttctaaaatgtctatagtaatattttaaaatattcacagaagaagttgaagtattattgataaggcttttgaagactattttgttcattaagtaaacagtaaaaaaaaacattttttgttaggtaaattttcaggattactcagaataagaatacttacagatataagggaaaactacctcaaaaggagtttaaagagattatattaaaatatatagtttgtacctaacgattaaaattttgtcctgagctcatcttaaattatctttgaaatcattaactatgtgttctgaaattttattttgggtacaaattgtttgagatggttgtttattttatgtatatatgtattcatgcattaattcatttgttcattcatattttttgtaatcttcagttccttatcatcattggcccaggctagtgctgtttcttcattatatgtgcatatatatgtgtgtacacgtgtgtatccatatatgcccttatacctacgacactaatccctttattctcctacagtgaggcaatcgttttaatgtactcaacgtgtatctttttatttgcacgtgtttttgtaaaatttgtgttgttggtttgtgtgtgtatctttttatgtaaattatgttatatatcatatactgttttctacatctttactaagcactatgttttaaagatccatttatactatatacatacatatatgtatatagacatgcatatatacacacacatatgtatattttgtgcatatatacacacacgtgcgtatgtatgtgtgacacatacacacacacacacacgcacacactcacattctaatttctaaatgcttcgtggttctccatagtgggcatctactacatttgaccctattccctctcccaatatggataaccagttgcctctacatctatacgaccgcaaataatgctacagtgaacatcctctcatgtgtccccttatagatccctgtgagaatttctctgagatatacatgtgggagtggaatggccgtgttataggtaaatatctatttctgtgctttccagaattttgcaccagtctgcactcccactagaagtgcttgaagattcccacgattgctcatttccatcagtatttggcaatgagtagtgttctagttttcgcctcagagaaatgtttaaactattttaaacacaaggttttcaagagtattctagtcactattactctgctgataaacctttattattattcatccaccaaaccaatctcaagaaaacctgtactacatgataatttgctagttatggtgtatgtattgtaaaataataaacttatttccttagaaaaattctttcagatattttattaatactgctaggatttagaattggtgatagtttatcttacattttatttctaatttgctcatagcaaattatattcatgatcaaagaatattttctgtcataattattgtccaaacagtgtttaggttgcacatggaatttaaaagtactcttcagtgagtaaatgacaaaatcctgtttttttacttagaacacttttaatactgtggttcacttttctataagttatactagtgggataggtcacatgcagactaaatgtagaaatataactaggctgtggaattaattagctttgattttgcatttatttgaaaaacaaaaaagaatatgaagaccactgacatatatttccactatttttctttttcaaatcatacaattgagataaagattcagtacttcctccaaataaacagccccgtaatagcagaaatgtaaattacaacacttctaaatctgtttttatcaactattgacctaactttattaaatgtacctaaaaatgtagggctactaagcagctggaaaataatgtattcagtttgtagaggggaaagacacgatacctttcctccgtgtcataaggttcttggctgacactcctataacaaaagacagattaacaagtgaaaagcataacacatttgtttaatcaaaattgtatgtgacacaggggacttcagaaatgaaaactcccaaacccggggaaaacgatgtcattttgtgcttatggttgttgaagagtgaatagctgtgaagaaatgtgactgaacaaaagggtatgatctagtgataatagaccgtggagggaaaccgagcaaggcctgtctgttcagattcttgtgacctctttgtgtagcattccttcttctcaggtaagggcaggaaccccctctgaaatgagggtattcaaggtataaaggaggagagggtgacttttctgggttttatccttgctttgggcaagaggggttctagtttctatgacttaccttggagaaggattctgtttttttataaattgcttcagagacagaaggagggataggagacaagagggcaggaggtcagaaagagaatttgcctctgaggctgcttctgcagccttccaatctcctttggttcaaagtaatcagcatgccaaagcactgttctctggggtgtcattttttgagccccagtaagtaaaagaagaagaaatcatgggcaagaaaatttcattgtctgtgtctctatctctgtctctgtctctctctacgcacccaccccccgccacacacacagagtaacaaattcacataaagaattgtaaagttattgtcaagatattttacttcagtacttaaatattaattgggtacttaccaaaaagcatgaacataaatacatatgtgttattttatatatatattatttataattgacaaataattgtatatagatatggggcacaatatgatgttttaatatatgtatacattatgacatgattaaatcaagctaattaacatatccatcaactctgctacttatcattttgtcacggtgagaacatttaagatttactttttaagcaattttgtaatatacatcaggccgggcacggtggctcacgcctgtaatctcagcactttgggaggccgaggcaggtggatcatttgaggtcaggagttcgagaccagcctggccaacatattgaaaccatccccctgtactaaaaatacaaaaattagccaggcatggtggcacatgcctgtaatcccagccactcgggaggctgaggtgggaggatcgtttgaggctgggaggcagaggttgcagtgagccgagatcacgcatcactgcactccagcttgggcaacagagtgagactccatctcaaaaaaaaaaacaacaatgtaatatacatcgaagaccttcagtctaattaggcaaacatactccaaaagtttattttagcaaaacgtggtttatatactacaataggctagtataaagaaaatatgttcattcagattttttcctcttaaacttatcaatatatctgatgtttttagaacaaattccttactttcattattttagccactactgagaagtcaatcatcaagtcactcatagtttgtctacttagggcctttcaccaatactcagtccctttaactggctacaccaaccaccatcacccttcccaaaaatacaacagaaaataaaataaaacaataattatagctcagtgacttcagagtactatcagtctatcactgtcagtgatttcttaccacttgtgaaatttcaaaagcctgccatgtactatttgtcctgtcaactcataccaggatcgtctgccaaatatctcaacatgaaggctctgtacaattacagacatctccatttgattcctcctctgaaatgtgttatttacatggttttttgtgtgtattttgcccatcattcactaatagtggcttactccaatgatatatagctatcctcccttctttacctagttaaatttcccagatgctcttcataggatccctctcaactattcaaggtctctttctatggtttaagggcttctcataaatgcagcctatcctcattgggtaaactatgggactagttagaggatagcagtaaggtgcatactccagcttttccccccacacggattcagactcatacttgggtaccttctgcctgaaggtgatggtggcagatactttgtaacccctgggttactaaatccttctcaatatttctaggtagccatgttattaccattccatttccacaaagatccctcaagtaccagagccaatattcaaacccagatctgtgggaactccaaatgctattctcatctctatatatgagggggtggggagctcaccaattctcttgacatgccaggagccatcttaccctttattttggtcaattttgttttgttcttcttttctcttgagctaatatttatacgctgattatgtgctaggcattgtgctaaatagtttaattattgcatttcattcccataattttactgaggtgtggctttatgaatgagcaaactgggacttaatgagtttaaataactgacccaaagtcaggcagctaataaatggtggagcttggatttaaacccagtctgctttaccttagcagccatacactaaacctgtaagcattcccaacaggacacatgggtttccatgattcagggtttcgtaaattggttaactgtgtttcttaggatcatgaaaaacctgcaggctttcagatttatttgaattatttttgaccattgagtcacacatggagtggattagttaggaaataattataggagtcagagttaaaataaaattaaatccagattggttataactcacacatttcactcttttatattttagcttccttttttttacataaataccacacatttaatagttttaacttgttattttggtcaaaataaattttgtaacgctgattcttctgttgtgtttagactatttggttgaatcaaggattttaaaatttgagtttaccaagttaagcactaaatcgaagtccaaaaccatatctgctttttatcccagtactttagacaataactagcacatagcagttgctcaataaatatttatttagtgaatatgtggaattactatacatttattattaatttgtacatcaaatgatctttcatcttttccttgaaaagtatttcctcattgaagaaatgctcaaattctgatacatctttcttcctaaaagagtatctttctaaagtccctaagcttttaagggtgctattaaatatatgtaaataatgattaatgaaaaatcaatctaattttaagatagtgatgcataccatctcacacaatgtgttttttcccagcttatgataataaaaaaatgtctctgagatgagaaagcatactgtatctgaaacctagccaaccacagctgacatcctcactgaaggttagctggtgttgactgatgcagggagggtacagatggaacaactgtagagtatagaatctagctctatgcgattttcatcttcctcagactaccttagatatgttagcaggtcaattggagacgggcaccaaaaaatggaagaaatgtgtaagtattaattgaagcctctgctttatgacttcgcattggctcaaacaggtcatttagtgggctcataaccagagtaaagtttccttaggcaaaaggtgcggatacagtcacagatggagtcattaacacaatcaacctatcatataagctaaactaattgtatttatttccataaattacatctggccttcctactacagtcttttgattttctactgagaagtgcatgctaaaaactaccttaaacacacacacacacacacacacacacacacaactttaactttctgcttactttcatttctgctaatattgtactttgtgctaatataattcattagctaaaatattcatttttgtagagactgagcaaaaggatagcagtcttttaaatagaaatatcatacagtatggcctttgtggtcagtatacaagacaaatatccacatggcatttatcaaataaaatttatgtatgtggacattttatttacatgcatatgttggaagaaagccatgtattttaaaaataaaaatgagctgatcattctacaaacgttgcagttgcctattataatgaaattgtgtgttaagtgtcactcttaaatcaatggagatgacatttgcatatcagtttaattgctttggattaaacattgaaagatgagagccaagagagcttattaagctgaaatgagggcaagtgataaaaaagtgatattatgtcaacactacatctggaggtctgttgttgtttccattttaaattctaaattgcagtgtttctaaaaaaattatcatcaaatgccatagttttgaaatatagtacaaaaattaaaacagttaatgcatcaattgtgcttgataaatacaatttgatttgaaagccaagctagggttttctctactttgttgaaatgtatttcttcttaatgtactagattgtaagattttgaaagcttttgaaaaacattatgtcttatttactgctgtatcttcaggactttgacatagtgtgtcctgtaataggtgctcaataaatatttgtgaataaatgagtcaatgcaaagtatggcaacaccttcatagttactgtaaaacactctaagtgagttcctgggtaccgctgattttggttgatgccagaaactgtatccacagctccctaccattcagaagcactgtgtgctcattggccttcttctttgcttgggggaatcatcagtcattattaaatatataaattcctgcaatgatctactttgaagtaggctatgtggactgtggcatgtgtgaagcaatttgattcccaattctgagggtctcctgtaggggtgtttgatttgagactccgcttagaaaccaccatttgtttgctgtgaccacagcatcagaaaactgatgacccatcattatccaacgataatgcagacctctttcatttgcattagagaatttgcatcacttccaggtattccctattgctcatcggagtgatttcatgtttgccagatagactatattgtgttagatcatctaaaacatagccttcaaatttgtttaaattaatccctccattgcagttatattgggggatttattttatggaatatctaagcatcttacaagcattatcttctcaatccttataacaagtgtgtggaaaaagttctatgaaatatcttcattttacagacgagaaaactgaggcacgggaaggttaagtggcatacctacagtatgtggaagagccaggttttgaaattagacagtctggttccagagggtgtgttcttaaccaccgtgctgtgagtaaataggtgcctgaggttcccctaaggtccctgaaaatgaagtattttgtatgccacatctatttcattgttgtttttagcttttaatcatagtacaaaaaaggtaacataaaatttaccatcttaactttttaagtatagagtttcagtagtgttaagtacattcacattattttgcaacagatctttagaactttgagttttaaaaattctatacccattgtacaactcctcatatcccctgtcatatctatttttaagtactatcatcccaaacatagcacctcaatctgatgagaagctatcatactattatcacttcaaatattaataaacagagaaaggagaatttttgtatttgcatagattagtatatgcccagaattcaaaatttagaaaaaatacgaatgcagaagaaatggagttgtattaatccgttctcacatcgctataaggaaatgcctgagactgagtcatttataaagaaagggggtttaattggctcacgattttgcaggctggacaggaagcatagtagcttctgcatctcgggaggcctcaggaaacttataatcatggcagaaggtgaagagaaagcagtcaagtctcacatgcagagcaggagctagcaggggagtgccgcacacttttaaatgaccagatctcgtgagaactctatcactagaacagcaccaaggggatggtgctaaccattcatgatggaccaagcccatgatccaatcacctctcaccaggctccacctccaacactggggattataatgtgacataagatttgggtggggacaaagatccaaaccataccaggagtgatttgaaataaaaagaaatgtcttagtgatttgtcttcctcttgtttctcagtttgaccttggatatttgcagaagaaaacttttctgatgtagtttatctgaatgacctgttcctaaatcatgacttcagaaatatatttttagttaaaagccaagaaaacaaaaagttatatttaatttacttgtttcttaaacacataagtattatgttaacttctgcataaaaataaattctattcaaacattgataaaaacaaaaagtacagttggccctctgcctttatgggttttgcatccatggattcagtcaaccacggattgaaaatatttgggaccaggcatggtggctcacacctgtaatcccagcactttgggaggtcgagatgagcagatcacttgaggccaggatttcgagaccagcctgtccaagatggtgaaaccccatctctactaaaaatacaaaagacaattagccaggcatggtggtgggcacctgtaatcccagctactcgggaggcttaggcaggagagttgcttgaacccgggaggtggaggttgcagtgagccaagattgtgccactgtactccatcctgggctaccgagtgggactctatctcaaaaaaaaaaaaaaaaaaaaagaaaaaatatttggaaaaaaattgtatatgtactgaacatgtacagatatttttcttgtcattattccctaaacaaaacagtgtaacaactatttacacagttggattaggtattgtaagtacatacattggattaggtattgtaagtaatccagaaattacttaaagtatacaggaggatgtgcataagttatatgcaaatactacaccattttataacagggacttgaacatctgtgggtttcagtgtccacaggaggtcctagaaccaattccccacagataacagggatgactgtatagacttttatatatgtatacatatttaaaattctatgtaaactgtagatagaattttaatcagtaaggtaaaaaacacgaatttcatataaatgcatgcaaaattatacaatctacgttgaagaaaataaaaaggactgaaaaagatatttatattaatacatattttcaattcttaattttctttatgtttgccatcatatttaattctcaaaaataaccctatataatagtttgaaatgtgatgtagtaaaggatgctaggaaaatagacttagatgggtggtgctcaggcagagaaggtgaaaggagttcctgggtgagggtcttcatcaacacatagaagtgagggagagcatggcacgtagatagcaccaatcgttacaaatggtcagagccctagatttgtgaatatggaagtggtaggagacagggaggagagataggccaaatccggatcaagaaagatttcctatagccaaataaattaattttaacgtgatttcacatattatagaaatgaaaggaaggggccaggcacattggctcacgcctgtaatcctagcactttgggaagccaaggcgggtggatcacttgaggccaggagtttgagaccagcctggccaacatggtgaaaccccgtctctactaaaaacacaaaaaaattagctgggcatggtgatacatgctattcggggggctgaagtaagaggatcgcttgagcccgggaggtcgaggctgcagtgagccaagatcgtgccactgctgtccagcctgggtgaccaagtgagaccctgtctcaaaaaacaaagaaagaaagaaaataaaggaagaaactaacaggaaaaatacttttttaaaaaagaaagaaatggtccggcgcagtttctcacgcctgtaatcccggcactttgggaggccgaggcgggtggatcacttgaggtcaggagttcaagaccagcctggccagcatggtgaaaccccccatctctactaaaaatacaaaaattagctgggtgtggtggtgcacacctgtaatcccagctactcgggaggctgaggcaggagaattgcttaaacccgggaggtggaggctgcagtgagccaagactgagccactgcactacacactccagcctggatgatagagtgagactgtgtctcaaaaaaaaaaaaaaatagaaatgcaaggaaggatattaattaatcaaaggattgtgtcgtagttagaaatgacacagataaaaatattttatcataaatccctttgctagtgtcaggacccattctgcttccaacttcataatattatattaccttaagttgggggttgatcaaatattaagaagaaagtctgagaatttttctaaggaccccttctaggtccacaagtcagagtagaagtagtttgggataactgtatgctgatagattttgtgtttttaaaaactacttggtaattattttgtcagttattctagcatcaaatattaaaggttctgacagtcgcaaggaagtgatcaatgatatttgcaaatgctaaagagaagatgattaccagccatccacagggatgattcaaatagcaaatatcattatggtaaaaacaaaattttcaacaaaaataactgtttaagaagcacagttttctgatatttttgataggtcaatttttttttttttttttttttttttttttttttgagacagagtctcgctctgtcgcccaggctggagtgcagtggcgcgatctcggctcactgcaagctctgcctcccgggttcatgccattctcctgcctcagcctcctgagtagctgggactacaggtacccggcaccacgcccggctaattttcatatttttagtagagacggggtttcaccatgttagtcaggatggtctcgatttcctggcctcgtgatccgcccgcctcggcctcccaaagtgctgggattgcaggcgtgagccactgcgcccggcctgataggtcattttttaaagtcaccttcaattcgagaaaatcaggaagataacatttttgagtaattttatctttacacttacatataaaatatttttaaagcatatatgcacatatatgaatttattcaagttttttttagggggaaaagagcttgatctagtgatatagtttattaactcactctgttatcttaacatatattgtttagaagctgtggaaatcatgtgtaattagcaaatataatcaaagttattttatatcataattatttattcttcccctgcaattccctgttgtaatttgtttgtttaatcagttcatctaaacttatcatttttcattcatttgtccattataagccatgaaacttttaccttttctctctcttaattataatcttgtctgatgaggacaaaataactgagacagaacagaggagcaagatgaatggcagacagcaggtgcatttgtatattatgaagtgtttgcaaaataataagcaccacatgaataatgcatttgaagaatattgtctggcaaatattattaagagtcatatatccaaatcatcccacaattactgaagaatgaaaaacaaagtgtctaatgcctctggttttgtcagacacagagagaatcaccatatagagcttctaggtagagcaaaagggcttctatttatttttatttatttatttatttatttatttatttatttatttatttattgagatgaagtttcgctctgtcacccatgctggagtgcagtggtgcaatattggctcagtgcaacctctgcctcccgggtttaagcaattctcctgcctcagcctcccaagtagctgggactacaggcgcacgccaccacgccaggcaaatttttgtatttttaggagacaggttttcaccttgttggccaggctggtctcgaactcctgatctcaggtaatccgcccaccttggccacccaaagtgctgggattacaggcgtgaaccaccatgcccagcaccacttattaatagaggactaaaaatttatatatatatctttatacaaatgtatatatctatattttatcatatttatatgtattatttatatatttgtatttactacatatatatgtgtatatataatacagttggccctccatatctgtgggttctgcaattgcagattcaaccaactacatatggcaaatattaataaaaaggatgattatgtttgcactgaacatgtacagtctttattcttgttatacttcatgaaacaatacagtgtaacaactatttacataggatttatattgtgttaggtattgtaagtaatctagagatgatttaaagtacactagaggatgtgtataggttatatgcaaagactgtgctatttttttatatattttatgtatgtatacctagcaaggtaaaatactgacacaattcaaaaaatgaaggaaaacctcagaaacgctttgattcaatgcttgtgtgtatgtgtttctgtttttgtttgtttttgtttgttttgagacaaggtcttgctttgcccaccaggctggagtgcagtggcgcaaccatggctccctgcagcctccacctcgcgggctcaagcaatcctcccacctaaggctgtggagtagctgggatcacaggtatgtgccaccatgctcagctaagtttttttgtttggggtgtttgtttgtttttctttttctttctttttttttttttttttttgtagagacagggtctccctaggttgcccaggctggttttgaactcctgggctcaagttatcctcccacattggtcttccaacatgctggaattacatgtgtgagccaacatgcccagcctctgtgtatgtgtgtgtgtgtgtgtgtgtgttgaaagagagaaaacataaagtaggactcaggattttagagtggttgatatgccactcctcattttgcctcttgactgtcttgctctatgaccactccttggaggtagctgagctgtttgtgttgctagtgttgctgcagccactggctgctgcaagaatctcaactgttctatcttctgttgctgctgctgctgctgctgctgctattgaaaagcagaagacagctgggacctctgctgagggaggctttaccaaatcttttctgggcaaaaccaacctgagatatcatagctgcctgaagctacagaaaacttctgactctggtgagattaatgagaacagctttatgagtccttcaggcctgttcttgattgcttgaaccttgtgcagaaccctgtggccttggctgtggagcatgagaagttgtgtgttgctgaaagtattgttgcagaatcaactgatggagcggcagaagcagcagcagctgctgctggatgttcaaaatgagggaaccaagtggaagctggagtagagttaatggcctgagacctgaggtacttaaaaaaaaatgctaaacacacctgattgaaaaggtgcctgcattctattggactgggccatgcatttggtagcatacctcctgaggaccgagggccactccctttgattctcgaaggaaatggggcattaacagtacagcccagcatggggtttgaaccactccccaaagcccaggctccgcagactgggcccactacattgatgactatttggacagttgagtttgccattacctaggaggctgggattgtttttgaggagttggaggagaccaggcagtgtgggggaaactgaccccatgattcaagtatctccacctggccccacccttgacacttggggattattacaactcaaggggattattacaattcaagatttgggtggggatacggcaaaatcatatcacttagctcaggagaaggtggacaatgagacagctccagatcctaattcagagaagatgtagaatatctcttgcagcattatttcactgagcctgtattcaccttttgctttttataggctgatcatttcagaaattctccctacctcggactccttgtcatgtggtccttatttattcgctgtctctcctgagtttggctagctcatgtcgtatatgttgttgtttgtccttttttatttagagttttaaaaatttatgattcatggtgtctttccaactttgcaatggcttatttaagtataaaatttatttaaaaacaaaacattaaaagttatgagtgaataagaaccagaaaaaattttttcgtaaatttccttttagagtgtcaaaatacaatttttctctgttttaccttgtgtgtggatgtttatctgtgtattgtttttgcaatgtttttatctgcttaattaatattcggctattggctttttttttctcagaacagtaatagaagatacgtttttgaagtggtaggatatgaagatgacatagcttacttaatttcatagttcaagaccagcttcttttgttgccattatgacatgaagtattttttttattgttaactgttgttattggtggtggtggtattttaaataaatagtacacttttccacaagccttgcgtctcctgattctttgacactcttgggtcattaggatccttcaactttagtctgttcttttttttttcccttagccataagtcttcaaagaatacatttcttctcaaaagtgcttccctgttcctaaaaggagatgtttacttctggtcctaaattctttttatgctcctttcttttgattgcccacaaccagtgctctaatctacctagtttcaaatattatctcagtatttcccaatccagcattgggcctcaatcacctcctacaaattattaagaataagaaaaatacctccggaggaaaattaggtcaaaataaatattcattaaaatatataaataatatttacatatatgaaaagatgctcaacctcacaataatagagttgcaagttaagactaaaataaaaggctatatttttgtattttctttttctctttttccttgtattattatttttatttgacacatattaattttacatatttttggggtagagtgtgatatttcaagacatgtatataatgtgcaatgatcaaatcatggtaattagcatatccatcacctcaaacatttatcatttcctgtgttgggaacattcaaaatctgctcttctagctatttgaaaatatacaataaattatttttaattatagtcaccctatagtgcaatagatcactagaacttatttctcctatctaaatgtactttttttttttttttttttttttgagacagagtcttactctgtcgcccaggctggagtgcagtggcacgatcttggctcactgcaacctcctcctaccaggttcaagcgattctcctgtctcagcctcccaagtagctggaattacaggcacctgacactatgcccggctaatttttgtgtctttagtagagacgggatttcacaatgatggccaggctgttctcaaactcctgatttcaggtgatccacctgcctcggcctcccagagtgctgggattacaggcatgagccaccgtgcctggccctaaatgtactttttaaaaaactaaacttagatacagggggtacgtgtgcatatttattacatgggtatattgtgtgatgataagattggggtatggatcccatcacccaggtaagtgagcatagtacccgataggtagtttttcaaagcacactctgtccttccctttccctctagtaatccacagtgtctattgttcccatgtttatgtccatgagtgctcaatatttagctcccacttataaatgagaacatttggtatttgattttctgtttcttcattagttcgctgaggatattggcctctagctgcatccatgttgctacaaaagacatgatttcattctttttaatggctgcatagtattctgtggtgcatatgtacccattttctttatccaatccaccattgatgggcacctaagttgattccatgtctttgctattgtgaatagcatggtgatgaacatataagtgcatgtgtctttttggtagaatgatttattttcctctgggtatataccaaataatgggattgctggattgaatgttctttgagaagtctccaagctgttttccacagcagctgaactaatttacattcccaccaaaagtgcacaagagttctcttttctccagagcctcatcaacatctgttattttttggcattttaataacaaccattctgactggtatgaggtggtatttcattgtggctttgatttgcatttctctgataattagtgatgatgagcatttgttcatatgtttgttggttgcttgtatgtcttcctttgagaagtgtctgttcatatcctttgcccatgtttaattgagttatttgttttttgcctgttgatttaagtttcttatagattctgaatattagactttcgccaaatgcatagttgtgaatattttctcattctgtaggttgcctgttcactctgttgatagtttatgttgctgtgcagaagctctttaattaggtcccacttgtcaatttttggtttcgttgcaattgcttttcaagactttgccagaaattatttgtcagtgcccatgttgagaaggctgtttcctaggttttcttctagaattttcatagtttgaggccttacatttaagtctttaatccatctggggttaatttttgcatatggtgaaaggtaggggtccagtttcattattctgcatatggctagccagttatcccagcaccatttattgaataggaagtccgttccccattgcttttgttagccccatcaaagatcagattgttgtaggtgtgcagctttatttctgagttttctgttctattccattggtctatgtgtctttttttttttttttttttttttgtaccaatacatgctgctttggttactgtagccttatggtatagttcaaagtcaggtagtgtgatgactctggctttgttctttttgcttaggattgctttagctattcaggctctgttttggctccacatggattttagaatcgtttttctaattctgtgaaaaatgacacttgtagtttgatagaaatagcattgagtatgtaaattgctttgggcagtatggctactttaacaatattgattcttccaatccattagcatggaatgttttgcatttatttgtgtaatctcttagttctttcagcaatgttttttagttctccttgtagagatctttcactactctggttaaatatattcctaggtatttttttgttactactgtaaatgggattatgttgtgatctgattcccagcttggatgttattgatgtatagaaatgctactgatttttgtaaattgattttgtatcctgaaactttactgaagttgtttatcagttccaggaggcttttggctgagtctttcggattttctaggtatagaattatatcatcagaaaagagagagagtttgaattcttattttcctgtttggatgccttttgtgtctttctcttgcctgattactctggctaggacttctagtactacattgaataggagtggtcagaatgggtatccttgtcttgttacagtttcgtgggggatggtcccagcttttgtccattcattgtgatgttggctatgggtttgtcatagatggttctcagtactttgaggtatgttccttcaatgcttagttctttgatgttgttgttgttgttttaatcaggaatagattttggattttatcaaaagctttttccagttcaatgaggtgatcatatggtttttgtttttaattatctttatgtggtaaattgcatttattgatttttgtattttgaaccaccttgcatcccaggaacaaagccaacttgattatggtgagttaagtttttaatttttcatttgtttttattttttttaatttttaatgttttgttgtgatgacctctctttttaattttttttttttttttttttttttttgtgacgaggtctctttgttgctgaggctggtctcaaactcctggcctcaggcagtcctccctcctcagcttcccaaagtcccgtgataaaggtttgagccacaatgcctggctgtttttaacgtgctgctggatacagtttggtagtattttgttgagaatttttgtatctattttcatcagtgatataggcctgaagttttctttttttgtcgtgcctctgcttggttttggtagcaggctgatgctaccttcgtataatgagttagggaggggaccttcctccttgattttttgaaatagttccagtaagattggtaccagttcttctttctacatctggtaaaatttgactgtgaatccatctgatccagggctttttctggttggttgctttttttttttttttttttttttttttaacattgaggaggttattttattttattatttattttttgagacaggttctctctgctgctcaggctggagtgcagtggcacaatgggctcaagcaattgaggagttcattttaaatgtatagtgtaatccacatctaagctctgtttgcagaatgagaggttgatgaaagaaagctcaatgaagctgcagagtcttaatcttgcttttggccgcaccagccctggcaggacctcgttcacaaagacagagaattaacatttgtcgaatgaatgaaggagatgccgtacaaagattgtatggttcctttcagagcctaaatatttaataggtgggtcactgagggtctgaactagaatatttgataagcagacatccagggttgagtgttagatgttctgcagggagatggatggaggggtacctacagggttctgcaagctcagtaatagatgttgttgaagaagaaatataagttagagacaggacaggacacacagagaatgcacctctttggggtcaataaaaaaagggaatgagcccagaggaagcactcaagatcagttgcaaattgatatcccaaatgttttggaatacttctaggaaaaaactctcctacatttcaaagtccagataatactgactccaccctctggcacagaggacttctatggcaacatagcacaggagtggtacatgaaggcaaagtccatttgtcttagctcatatcaaatggtaaagcagagcttcttttattttaatttagctattcaagctgctgaagctatacccaaaatccctagccctttctctgatatgagtctctgtgtttccatattgggagcaatttttttttttttttttttgagatggagtctcactcttgttgtccagactggagtgcagtggcatgatcttggctaactgcaacctccgcctcccaggttcaagccattctcgtgccttagcctcctgagtagctgggattacaggcacccgccgccatgcctggctaggttttttttgtatttttagtagagacggggtttcaccatgttggccaggctggtctcaaactcctgacctcaggtgatctgcctgccttggcctcccaaattgctgggattacaggcatgtcccactaggcccagcgcaattgttttttataactagaaatgtgtttggctttcctccaacaaaccaggaaggtcaagagatatgttctagatacctctttgtggttgcttaatgcagagctcatgcagacacatctgcaaacctaaggaaacgaccctctaaggactggttagccacttaaaatgtgggccaagataggctattaaattcgaatcctcactgcttcattacagcttcctcacattgttagcctacaaactaagttaaggacacacttaaattccagaagttgatattagtctattcagagttttaatctcttcttgattcagtcttgggagattgtgtgttttcaggaatttatccatttcccctagattttctaatttgtttgcatagagttgttcatagtagtctctgaggatcttttatatttctgtggaattagttgtaatgtcatctttgtcatttctgattgtacttatttggatcttctgtttttttctttgttaattaagctagtggtctatcgatcttgtttattctttcaaagaaccaactctcagttttattgatctgttgaatggatttttccatcttagtttcatacagttttctctagttttagttatttattttcttttcttctcctagttttagggtttgtttgttcttttatttcctagttcatttaggtacaaagttagatgattgttaatttgagatctttctaacttcttgatgaaggtgtttatcactataaactttcctctaaacaccactttagctgcattccagagattttgataagatatatcccgattttcattaatttcaaagtatattttggtttctgccttcatttcagtgttcacccaggagttattcaggggtaagttgtctaatttttgtgtatttgtatagttttatttttttttttagaaagtgtctcactctgttaaccaggctggagtgcagtggcatgatcatgggtcactgcagcctcaatctccccaggctcaggtgatcctcactagccacccagatagctggagaactataggtgcacatcaccattcctggctactttttttgcatttttttgtagagatggggtttcaccatgtcacccaggctgttcttgaactcctgggctcaaacaatccacccactttggcctcccaaaatgctaggattataagtgtcagccactgtgccctgcttatttgtgtcgttttgagagaccttcttgatagtgatttctatttttattgtactgtggtctgagagtgtgcttgacatgattttgattgttttgaatttactgagacttgctttatgactaagcatgtggtttatcttagaatatgcttcatgtatagatgagaagaatgtatagtctatggttgttggatggagtgttctgtagatgtctgttaggttcaattggttgagtgtcaagtataagccttgatgatctgtttatcaccctgctgtcagtgggtattgacatctcccattattgttgtgtagctgtctcagtctttttgtaggtcaagaagaacttgttttatgaatctgggtgctccaatgttgggtgcatatatattaaggatagttaaggcttcttgttggagtgtaactgttatcattatgtaatgcccttctttgtccttctttattgttattggtttaaaatctgttttatctaatacaagaatgatgactcccactgtcttttgttttctgtttgcatggtaactctttctgcatccctttactttgagtctgtgggggtgtcattagatgtaaagatgggtctcttaaaaacagaagatgattgagtcttttatttgtatccagcttgccactctatgtcttttaagtgggacatgtagcctatttacattcggggttagtattgatagatgagattttgatcctttcatcatgtagttagctggttgttatgtagacttgattgcatagttgctttttagtgtctgtgggctatgtgcttaagtgtgtttttgtggtagcaagtgttgttctttcaatttcatgtttagcattcccttaaggacctcttatgaggctggtctagttaaaactaattccctcagcatttgctcatctaagaaagatcttttttctccttcacttatgaagcttaatttggtaagatataaaattattggttgaaatttattttctctaagagtgctgaaaataggctgccaattttttctggcttgtgagtttctgcatcaaggtctgctgctatcctaatggagttccctctgtacatgacctgagccctctctctagctgcctttacatttttttcttttggattgacctttgtgaatctgatgactatgtgccttggggatggtcatcttgtgtagtatctagctggagttccttgtatttcctgaatttgtacgtcaacttctctagtgagattaagaaaatttttgtgaactatatcctcaaacatattttttaagttgcttattctctcttcttctctctcaggaatgccatattggtcatagatttggccactgcacataattccctatttctttgaggttttttttttttttcattttaaaaattattattttttctttatttttgtctgattgagttgattcaaagaacaagtctttgagctatgagattcttttctcagtttggtctattctgctattaatacttttgattttattataaaattcttctagtaatttttcagctctagaaattcagtttgattctttcttgaaatggttatttatctttcagttcttgcatgattttacttgattcattggattccttggattgggtttcaactgtctcctgaatctcaatgagcttccttgccagccaggttctgaattttatgtctgtcattttagtcgtgtcaggctgtttaagaagcattgctggggagctggtttgcttatttggaagtaagaggatactctggctttttaagttgctacagttattgcactgattctttctcctctgggaggactagtgttcttctatctgtggtgtaagttgggtatagttggttgtctttgtttctgcgtgttttctgagggtcaaggttctgtataatgtctttatttatggcttaattcttgcccatggtttcacaggaggatatattagcaaaatgtttttggtgctgtagtttgggctgcaatcctgtagatggtacataggaataacggtcagtagataggctcttactcagctgtgcagctcctgtgtatttccttgcatttgcagccatgctctgtggtataggggggagaagagatgacctcctcaccaggcctgctcctgggtcttaggaaacccctctgattacttccaccatgcccacatttattttgttaggtattctgggccatgggcctcccttgggcagaggctataacatggagatagactactccctttctggactggccttgcagagggaggcatgcctcactcccatgccagtccatgaacccatgtgtttcacccatttcagtgctgtgagagtgggctcctcccccactagagtgttgcatacagatctcagcttagcattcccgaactgtgcaccacagccttggggcaccaggactggctcgcagctctatcctctagacgttcagggttggtttctgggtgcactgggaaatccaaagtgctcccaggctgctgtgaatgtactcaggtgaagcaaagcatccaggctgggcagcataggctgtgccatgtatacattcctgtgtgggggaatggggggtatccaggtagaggctctgggaagggcttttgggcaggagagcctgcgaagtagacataccctagtcctgcaggaaagccagccccactttctcctggcctggcagtcagttgggcctagagattctcagaggaaaatggggatccctgtgggatgggcacctacctaaggccatgccctactggagctctcccacacagaaaggctcctggctttgcaccagctgaagcgttgtctctacctactctctgggtagattcccctgccagctcaaatgtctgtgggggacatggaatcccctgtagctaggatcccagaggttcacagtgagagtgggcagtcccacagcttctttactcacccctttcccaggagccatttggagccgaaaactagccataacgttcaggtaccttatacacggttcccagattcctctctcttcagcctcagtgcctgcgtcacatttccatccactcttggcatttttctctccaaagatgtattcaaattatgttgctttacttaacattttggtccctcttggcgggaacagtgctttctagctgtgtctagtaagccatcttgtcccacttcctagctgtatttttttttatctgttaaccatcctttggctatccctctcccttccctacccttccctgcctctgataaccactattctactctttacttcatgagatgtattttttagcttccacatacatgtgagacaaatataagcggtatttgtctttctgtacctgacctatttcacttaatgtactccaggctcattcatgttaccatgaaagacagaattttgttctaaaagaccattcttttttttttttttcctactagattactgaagatcggaacatttcatagcttatcatgttagctaatggtgtggggaaacagacacactcaaatgttgttgagggtttattttgtgtttttttgtttgtttttgagatggagttttactcttgttgcccaggctggagtgcaatggcacgatctcagatcactgcaacctccgcctctcgggttcaagtgattctcctgcctcagcctcccaagtagctgggattacaggcatgcgtcaccacgccctgctaattttgtatttttaatagagatggggtttctccatgttggtcaggctggtctcgaactcctgacctcaggtgatccacccgccttggcctcccaaagtgctgggattacaggtgtgagccactgtacctggccattgttgaaggcttgtattggtccaattcctatggataacaaagaaactaggaataggatttaccttcaaggtttttgggaatttctcaccactggcctatagtctcattaaaaatctactactttttaaaccttttaaaaataaatgcaatatttaccttgttgctttgtataccacctgcacaccagtgttactggtcagtggggcagcactactacattccgagtatcacttggtaacatgagagaattcaagaggaaatgtatagcaaggacaaaatcctaggaaaagtctagcatttatgaagaaagaagagaatgaatagaggcatattacaatcaggaatagacttactaataaaatttcaagaagaatgggagtaaatagtattaaatgccatggagtgctcaagccagttaagtattgagccagtgaaactattgaaaccatgtaattgttgaaaagtaggtttttgatagccttagtaacaacattttctgagaaatagtggagaaaaatcagaacatagtagaaaaacagatgagtctgtgttgagaaagtaaagagagtagcttagactgtcctgaaaagtttttgttagtgttgagaaagaagtgagttacaggttaaaatagaggacacacacatgcatacaaaaaaattaatagctttgtgtaaaatctctcaataatgcaataatagaccaggtaaatacaacataaataatgatgttaccaataatgtaattttggaatttttggaattgacataagctttcatggagatttttatatgataaatgaaaaagtaacatacgcaaaagcctctattcaaattaatgacttggctgggtgaggtagcacatccctataaccccagcactttgggaggccgaggtgggaggattgctggatccctggaattagagaccagcctgagtaacatagggagacctcatctctacaaaaaaaaaaaaaaaaaaaaaaaaaaaaaaaaaaaaaacttagctggacatgctggcatgcacctgtagtcccagctactcaggacactgaggcaggaggatctcttgagcccaggagttcaagaacagtctgggcgacatggagagataccgcctctacagaaagtaaaaaaacttatccagatgtggtggcacattcctgcagtctcagctactcaggaggctgagatagaaggatcgcttgaacccagaaggttgaggctgcagcgagccatgattgtgccactgcactctggcctgggtgacagagcaagactgttgccaaaaaaaaaaaaaaaaaaaatatatatatatatatatatatatatatatacatatacttatgtgctttgtacattatagacataataaatggtagataatgacatcagtaaccacaaagtcaaattatacagcaatacttcatgtaattttgattccaaataaatccatattagtaaaagaaagccaggagcattgtaatagcttttgtaaattagccaccaaggtagtcaatttacagttgtatttaatagactagtgaacagaagggttttgagagtgggaatgattacaatgctgttgcataaattggagctttaggaaagcactgaaggaaatggtgtccagttaatcattaagatattcttcacgtgcatatgaagaataatttgggaaaacttgacattcagataagactgaatataattgggttaaactgcaataatacatacatgttctctattttcttgctattatcataatgtacttttaaggaagaggcagatattgtaactgaaaatcatggatacagtaaagccatttcagttctttgttacagttgtttcctatgagaagaacatgagaaatgatcttatagtattgacagaaaaggagtgttgacagctgactgttgcaaagcctccagtgtaattattccacctcccctacggccagggatcagtgtttttcatatgacccatacttctgaaaataatgaatttcaaaatgtctgttccatgtacacagttgttgacatacacaaatatttagctatctagttctagaatccccttggtgtttcatccatctgaaactgagaaaagagagcagagtcagtaacagataagccctcgttgctgttttatttatgtatttgtttatttatttatttatttatttctgtactgctgcatctagggatgccttccactggatgcctctgtgtcaactgcagctctttcaggcaatactatgagacaagattaactgaatttcaaatgtatgagactccactcacagaaagggtgttctattcatactgaatctttctataaaaatgcaaaagttggatctggagaacagaaaaaggaagagagctgcattcacagtaggataaggagattaaataggaagagttatgtgatttatctcttttatgaggtgctgctggaaagcagattaagctttttaaaaagtggtgaccttgatataaatttcatatttagccagtgctgatggattttgaataatgaagggtatgtgcaacaacactgagcctgagaagatgcaagaaatgtagtgaagttgaccataatctgagtgctaatacatcactgcaaacaacagtaacaggaataatacctattgtgtagcagtttgcccattacaaaatacattcacaccaggatgctatttacttctcacaataactctatgagattaagtatccttagaatttgatgatctggtgctgaagttcaagaaagatgttacttgttcatagtcacacaacttgcaaataaattcctctccctgtgaaaatattctcttcttatattcattgtcacattcggataaagattggacccacttgtattttatttctaacacttttaatcatacctctaacataactctatggtattacattctgacaactgaaatgtaaagtgttttatttctgcattgtctctgttgacatgaatccttaatataatgtcatattctgagcatgtttatgtttataaaaaaatacaaatcattaggccattttctttttccaaaaatgaccggttattgccgagtaaagttactaggttgctggtattcaagccattcgttattttaatgaataataggtaattcagattaatggatttccattctagcaagaaatctctaaaaattacatggacttgaactgatattaaaattgtatataaaggaatggaaaggaaaccaactgtgaaatgtgtccaaatcatatagaataaaaaagttcccttccccaaaaacctaactctgcttttaaattctactaattcacagtgtaattctgctctttccttttttcctgtttttggctttagatacataaataagaggctttaatcatagaaaggaagctggaaaagtaccttaacttattacatttaccatgtttgaacactgttatttgtaatatttgcaaatgtacaactatataatttgtttatctttttcttttacctcatgggagacttctaggaatttatatataatgtggattaaacacttagactatttgttccctaagctactgtattggccaggacctagtcagttaaagcaaattcattccagatagttcagtagaagaaacttaacatgggaaacaggatatcaatatgctagaagagctgaaatgacccagaggttagcaacattaggaaaccactaccacccctatatatgaagggacaaagagaagaaggaagtcatgttaccagaacccagaaactgaaaggatagatcccctcttgtaaaaattcatcaccaatgccatttgtgaggagaaactgggaaattgagaaactacgtatgggataaagtggtaaacaaggcagataagactccctcatgcatgactcttacaatgttatggaggagaaaatatataccaatataaagaaagaagacaaagaaaagatcagttagtgataactgagaggataactataaatataaaactgagtgtatgaaaaaattatgagatttattcttgtggattatttttgcattaatttaatttttgaatattgcattgaaatattatctatcttaactagtgagtttatggcaccccctcattcaactcatgctagttccattggggtaagcccatgatgtttcaaaggactttcagctattttgcttgagcaattcggtggatggtgtagtatatgtcacaaataaatgaagcaactttttaagatttcaaaaaggcataataaatagacatttgaatatataaatctagaattcagagctggagatacaaataaaggagacacaacatagaaatggaatttagagtgagagggttaaatgagattacatagagggcaatgaaatgagataatgcattaagtctttttgaaatgatggcttaaatgaaatataattcatatatcatataattcacccatttaaagtgtaccattctaattttttttaactgtggtaaaataccacacaattgaccctttgaatcatttttaagtataaaactagtggcagtaattacattcagagtgttgtgcaaccatcaccactatctatttccgaaattttccatcatccaaaatagaaattatttacccatgggcgcagtggctcaagcctgtaatcccagcacattgggaggccgcagtgggtggatcacctgaggtcgggagttcaagaccagcctgaccaacatggagaaagcccgtctctactaaaaatacaaaattagccgggcatggtggcacatgcctgtaatcccagctgctcagaaggctgaggcaggagaatcgcttgaacctgggaggcggaggttgcggtgagccgagattgtgccattgcactccagcctgggcaacagagcgagactccgtctcaataaaaaaaaaagaaaaagaaattctttacccatgaaacactaactttccattccttcctcccaccagctcctggtaacctctactctactttctgtgtctatgaatttacttatcctagggacctcgaataagtttaatcatacaatatttatccttttgtgactgactgatttcacttagcctaatgttctcaggtttcatccatgttgtatcgtgtatcagaatgtcattgctttttaagtctgaataacattcctattgtatgcatataccacactttttaatcttttcatttgttgatggacatttgaattgtttccaccttttgggtgttgctgctatgaatattggtgtacaaatatctgtttgagtcccttttttcaattattttgtgtgaatacctaggagaggtgttgttggatattctatatttaacattttgaggaactgcgaaactgttttctacagtgactgcaccaatttacattctaccagtaatacacaagggttctaatttctccactccttgccaatacttgttgtccaacccccaacacactttttaaaaattttttttaattattgtcttttgagacggagtctcactctgtttctcaggctggagtacagtagcacgatctcagctcactgcaacctccgcctcctgggttcaagcaattctctgcctcagcctcctgagtagctgggattacaggcgcccaccaccaaacctggttaatttttgtatttttagtagagacggggatttcaccgtcttggccaggctggtcttgaactcctgacctcgtgatccacctgccttggcctcccaaagtgctgggattacagatgtgagccaccgttcctggcctacactttttattttttgataatacccatcccagtgtttgaggtggtattgaaaggtaaagctttctatacaatatttcttccttccccagtttgcctctcaataggatataaactccataaaatcaagtactctgtttattcactgctttatccccagccaggccacgcatatagccattgctcaatacatgtgttgtattgactgagtgaatgattttttttttttttttttgagacagggtctcattctttcaccaggctggagggcagtggtgtgatcttgtctcactgcaacctctgcttccaaggctcaggtgatcctcccacctcagcctccccagtatctgggactacaggcacacaccaccacgtctggctaatttttctattttttgtagaagtggagttttgccatgttgcccaggctggtcttgaactcctgggctcaagtgatctgccaacctgagcctcccaaagtgctgggattagaggcatgagccaccctgcccagccgtgaatgaattttaaatgctcagtaagtgagagttgtattcaattctttaataaataatatcatatatttagtcttatattacattgcatcgccattgctgggcttagtgttttctttttgttttattttgttcttatgaaacaacatcctttttgaattggaaatttaaggaaagatatgctgcatatacatagaatgaaattatttcaaaccatgacaggggaagaggagatgaacacgggatgaaagagttgaaaaatatgaaattaggaagtggtgaagaaagtcaagtaaaatctcatgtcctgccttcaaattagagcatcaagcaggtgctatgaacatgtaatttgagggaagtgcctgtgattctcttcttcagggagcacttctggtttgcgttttcattttctctagaccttttatagatgaagaatatcttgtttttccagatgcagatagtctgttatgttctgtctgtgtctgcagagtatggacccatttctaaatgtgctgagttcaaagatgtcactttttatacgaaactctgatcatgagttttggtaaatattatgaccaccttagaaaaagctgcctttgtaaagcttggagaacaaaaagtgatgtgcaacttacccaaatgtgactcacacatttatcttccctatcccttgtctttcacatcgagaatgtcaactatggttagaagaaggcctgttgtgtgtaggatgaaataagaagatcatcaggtgattgtgtgtagcttttcagtgcagagtatctttacaactctatgtcaattttttgccgggcatggaagacacatctgtttgccgtatatgctatcaaggaatatgtgttatttatagctgggcgcagtggctcatgcctgtaattccagcactttgggaggccaaggtgggtggatcatttgaggtcaggagtttgagaccagcctggccaacagggtgaaaccccgcctctactaaatatacaaaaaccagccaggcgtggtggcaggtgcctgtagtcccagctacttgggaggctgaggcacgataattccttgaacgtaggaggtgaagtttgcagtgagccgaaatcatgccgctgcactccaggctgggcgaaagagcaagactctgtctgaaaaaaaaaaaagaaaaaaagaaatatgcgttatttcaaaaccccagaaaatgaaagatggcaaaaaagtagtatggttgagtttaggtgggagttgtttagaaaggttaagccaaaaaaaaaaaaaaaaaaaaaagcaatcagaactttgtagctattagctaatagttcattcatttattcatgtaatatattgagagtacctcctaaatgcctggtactgtactaggcacttaaggagatcattaggcctttgaagtctttagcctcaacaggtcatcagtgaacaaattcctgtaatgaattaccatccatgtgtcaacagaaactgaaatgttcagaaaaggagaaagagtttaagagattaaaaaaaatatatatatattcctggtccctcaaaaagttaaaccatatgacccagcaattcaaattctagatatataccgaaaagaattaaaagcagggacttaaatatttgttcatgcatgttcatagcagcattattcacaatagctaaaatgtgaaaacaaacccaaatgtccaataagcttatgattggatacatggaatgtgatatatcatacaatgggctaatgttcagccaaaagaaaggaatgaagtactgatgcatactacagcgtggatgaaccttgaaaacattatgctaagtaaaagaagccagatacaaaaggctacatttatatgatgacatttatatgaaatatccagaataagcagatccatagagacagaaagcagatgggtggtttccagttattgtagggagagaggaaagaagaataattgctaatgggtactagcttttctagtcttagaactagatagaggtgatcattccaaatcattatcaatgtattaaatgccacttaattataaactttaaaatagttaatggttcattttatgttgtgtgaattttacctcagttaaaaaaatgtgtgtctaagaattcaaacagcatacagcttacttctttattttacatattatgagaagcatacatattaatagtggatgtagcaaaatgaggataaatactgtaattaaaaattgtgattgttggccaggtgcggtggctcacatctgtaattccagcactttgggaggccgaggcaggtggatcacgaggtcaggagatcaagaccagcctggctaacacggtgaaaccccatctctactaaaaatacaaaaaattagccgggcgtggtggcgggcgcctatagtcccagctacttgggaggctgaggcaggagaatctcctgaacctgggaggtggaggtagcagtgagccgagattgcgccactgcactccagcctgggcaatagagcgagactccatctcaaaaaaaaaaaaaaaaaaaggttaaaacggataaagatcaaagaaatcagccataggccctgaagaaattatatgtaatgtatgtaatcttgaacccatgtcctgggcctcagtttccctcagtgacatggtttttacttcttctccctcttatcttttcccttactcttggaatctacagaggtgaagtttgaaagtgttcatgtccaagaataactcagacagagaaatactggactagaattgtatatgcctaggccttctcaattctagtattccaggaataataggttagaaaaataaaaataggaaaattatattgatcactttctactaaaaaagagaagacaattatcttgaatttacagttagcaaaagactgtaggtggagttcaattcaccagttcaacaaaatgtttaaaaaagaatttcaaatgagaaggcagtaaactggcatttttaggttttaagcatctgctcaatggtctcattctaatcttttcaccaagggctgatttcaaccagggttaaatcaataggccctccagagctcttctgaaaagaaaaactaatccaaacaaatctctcatttagtattagtagctacaaacatactgtgtttaagaaagataagatataagagagggacacatgcatagcttcaggcattaccataaagactgacagaacaataaaaaaggaagaaaatggaaggctttaagattagaaataaactttcaaagtatatttaaggtttaacaaactctaagatgctctttccacaatctaaccttgacactttttgattcctaacactttatgtttacaactaatgattagacacgatggtcaaatttctggttgagaagctgccttccagacagttcacttctgcttgagtctgtagtaactgaaccttcagatctgctgccactctgtgctggttttcagtgccaaaggcttatgacacttgaaaaatattatgtgccttcattcttacaaaaaggaaagctcatgacttgaaaaatgaccagtgaatgttagagtagaccatataaaacacagaggcatagaacaacttaatccttttaaaaagttaatcaaatccctggctttcttacacactacttcatgaagtaggaaaagattgccaaacattatgaaaatggtatttcccttagggacttgaggattagcagaatatacaggtcatgtgtttagtgatcctattagaggatacattttacaatcatgtcactggtaattctgctagagtaagagagagataccaaacactacacattatcgtacatagggcatgtgattacagaataattaaaactgtgctacattaaggtatcacataaatggtttttaatatcctttgtcagtgaatcagtgatatacaaaatttccctttccacacatattttccttttttaccttctgcctgcactacccaaatttctgcactttgatctatagttatgcaatgtagtcatccttttaaaaatgaattttaaaatctctgatagcggccaggcacagtggctcatgcctgtaatcccagcactttgggaggctgaggcaggtagatcaactgagatcaggagtttgagaccagcctgaccaacatggtgaaaccctgtctctacaaaaaatacaaaaattagcctggcgtggtagcatgtgcctgtaatctcagctattccggaggctgaggctggagaatcgcttgaacccgggaggtggaggtttcagtgagctgagattgcaccattgcactccagcctgggcaacaagagcgaaattccatctcaaaaaaaaaaaaaaatctctgatagctcccatgcatatcaactctgaattgtcttctatttcaaagtacaacagtactgagaaacctgtggaggagttcagggtgctgctgtactgacttctggaaactgtatggaagtaattattttgaatttatttttgtgtcatatatcgattacttgtgttcaaaaatatttgggaattcccaatattttcactgaatcagattttttttttcttctttgtaaggcgggactcaaagccagtgcttcagaagtaaatgcttttatatagtagaaaaatatgaagaaaacatagtatttcaggtcatttgctcccttatatcacttatcagattttggggactttaaggacctaaattttcaaaaaaatcaagttagatcatggatttttttgaaaacttgggtcattaaagtcctgaagaaaatttgaaaatttaagtccttaacgtccagaagacgtttattttagactgtaaagtaaagtaaaaccaagggttaagggtaggtaactttcttttgttttaaacaatggtatgtctatatctatatctattatcatctataggtatatagcgtctatgtgtgctaacccagcaccaattgcctcccctagcttatagaagagaccagtgaattagaagtaggagatgtgagttctaaccccatttctaccactaattagataatagaattcgaaaaactcattgacttctttcagcattgggtccctttgctgtaacatgaagacattgaaagaagtaactttatgttagttgtttctccaatatgttgtgtgtgtacctggtgtggacctcacggtcacccttgccagagacaactagattttttttttaagtctatactaatattctttcctcactagaaaggatagtggggtgtttactctcagttgtaaataactctgttttctctgcctgtatgcatgtcctgtctctctagccattttataaatactgaaaccagtaatcatgatttaagtttttgtgtagactgcagctcatctgttataaacaataaaagctgagtaaatatgtgctaatggttttaccataagtcctgtaggagcattctctttaccccatttaccccattccacgttatttccctgacagcagagaaccatagcagttatgtcgcgagtttgatgatggtggaatgtactctttgctttgagagtgtgtaaattcccctcaggggtgtcatatgtttattaatgtgtcacaagttgcttgcttcctgttagctcttctcagtaaataggactatagcattcgttggatactactttatttttagctttttaaatcacctcctgatgaacagaaacagtaaacaagtattaaacatcgaaagtaatttgaaaatagtgccatcctggagagtctggagttccagacattaccagacactcatctcacagagctgaaggagaagttaggaaaataagaatacctaagtgatgctcctctggagccactttctgaagattaggggacatttgtatttaaagaagagaaagaggtgatggctgtggtagggagtccatatttaattcaactttagtcattcttattcaacccactcatatatttcaaatgaaaagtataaggacttatctggatttttaagcttcacactaattagacaccaaagaactgaaggcctcatcatggtagtattttctaatttgttaaacaaacactgtgcgactgtactgcaaaatggaagtataaagaaactgggaatgaaggaggcggtgccgataataagatctaacgcttactgagtgttctaagctctttatgagttttattgtattcgtttcccacagcagcctatggagtctttggtattactttcaccttatcctaataaggaaatgaaagccaaaggagccaagtaactttccctagttttctgttttttgagatggagtctcgctctgtcgcccaggcttgcagtctcgcgatctcggctcactgcaagctccgcctcccgggttcacgccattctcgtgcctcagcctctcgagtagctgggactacaggcgcccgccaccacgcccggctaatttcttgtattttcagtggagacggggtttccccatgttagccaggatggtctcgatctcctgacctcgtgatccgcccgcctcggcctcccaaagtgctgggattacaggcttgagccaccgcgccctgccaactttccctagttctcaaaaataatgagtgattgagcttgaatgagtgattgagattgaacccatgaggttgggctttggagtcttgctcttcacttgaccctgcctctctctctctctctctgtatatgaatgtctcgtattccatacaaagagatatagtacaacagacaaacaaaagtaatcaatagtttgaggagaaaggaaacctaagactcttgtgtctaaacgatttatgtggaagtttcaaaattatgatgcacagatttactttccttaaaaggcctttctgtttttgtttttgtttttttttttaattctgtgttctacaaatctgtatccttccaaaacctaagcattttctgaaagcatatttgaatgtgccctaaaatagttaataggttaatgtagataatttttttctgaaaaaataatcttataatgagcctagaaagagcatgctccagtcagccctggagtaaaattaataaataatgcatgagcagtattgctggcaaacccaaagagggatatctttttcacttgggtgtgaagctcaagctaaaacttaacacactcttttctctcaaagctgtttctttttcagtgttttttatgctgaaagattgactctacctttcatatactcaactgagaaaaattcttgatcatcttggatgcctctctctttcctttgcttcctcactgttacattgattcagtgtcttaagtatattttgaacatgatccctcttttctgtcccaatgtgtattgctttcattggggctgccatttgtttctgagtgaatgcagttgctttctaatttgcctcattgcatttattcttccttacagtcaaatccatttttctcattataatcagaaaaacctttctaagatccaaatttcatcattccttaacataaagtttaaactctttgaagtggcttatgtgactttcagtcttgcttctgtgcatttgtccagtctcaagtcctttatactccagtcactccacattatttgcaattacttaaacacagtaagttgttttatgccttccaggctttgtgcaaaccgttacctcagataacccttcttaaaattgccaaattcttattcagtctctaagatagttcaggtatcatcatttatggagccttcttgtttctttctttgataccactgtggtagttcatatctctttgtagtaattatcatattgaatttcagctgtttatttgcctatctctttccctggattgtgagggcctgaggacagggaatatgccttattctagcaaaattcctgaacacacacgctcaggacttttttcaagcttctgattacctttgtttaatggctaattatttcacctattaagtatctttcatctaattgtaggctaggtattataggaagctagagatgtctacattcaataaagaaccatctaattttgtggaaatattctttgttaccagatataaagcctaataacctacctatctattttctggacattctcactgtgtcatattagcattcaacaaaagcaagaatctaaataagggagctgcttaaatgtcaaagcattagctgaataaggaggaggacttaagagatgttgtgcatgtgtacagacacaaagaggaaccagcagtatcacggagcacctatgacaggccaagcagatttctatccagtatcctttttaatgctcagacaagtgctggctctcccatgagtcccacctgagactcaaaggagttaaataaattgcccagttttgtagagatggtaagcagtgagactcaaatacaggaatttgatggccatgtacatgaataagcagttgggcacttatttaccaaatgggaagttctaaagcaaactttgaattcaatattttattcctctctttcttctcattagccagcaccatgcctgacacatgatcagtgttcattgaatgtcctgagacttaaaaagcaagtagaagtagtgcaatttacccaaaaaacttcatttggtctcaacccttccaaaagatctctgcacaggatttatagcctcacttattccaagttataaacttgatttatgtaccaggaagaaaaaagagatgcttatttaatgacccaattctgtagaatctgtctatcaggatggggttgttcttatgtaacacagtagaatgcttagctctgacaacctggactctaggttccaacccaagtagatatgggtcgataaagatagtaactttgcaatacttttatccaagaatgtgttctgcccagactcagtaactactcgtcttagcaagacaaccaatagtgtaacttttatccaagaatgtgttctgcccagactcagtaactactcgtcttagcaagacaaccaatagtgtaagagtatgcagcattattcctgaacctcactgtgattaataggccagttacacttttctacttctattgaatttgccaattttagcataagcccaggcttgactttattctggacctaaatcttcctttattttttttctaggtacaaaatatctattaaacattttaaaacttaacctgaatgtaaaacaaaactttttctctggcaaataaaaacaaataaatatacatttagcttcacaagagcaagtattgtttagctgggtagcaagagagaaccctgtggaataagtcaagataccataaaattagttaaacagtgaagtttttgcttttcttttaagtgaattaaatacactgccttggcagcacttgctttttgttcacaccaggtcactgtatttattctgctttgttacagaaactccacttactgtatgaaagtatccatctcactgacagtgggtgaaaatgacactggactctgctataattccaagatgaagtattttgaaaaagctgaacttagcaaaagcaaggaaatttcatgccgtgacatagaggattttctactgccaaccagagaacctgaaatcctttggtacaaggtatggactgcgggtggttctatttcctattaacaaattaattgtgccttatattctgggacaaattggatagaaaacttagatgggtgtgatatagtttagctttgcctttctagaataatatagcaagttgtactggtcattatatgttttttaaccaatggctttagtaaattctagtcaatgtttgtattggtaatccactgtaataagctgttgtgtttatgtttatattttatttccatggacaattctttcaagtctactatggtctgggttgataatttcaggaactaaattaccttgaaccttcttttcagggttcttcacattagcatttcaaagtgtccccaaacaaaaggaaaaaggactgatttttttccaggataaaatcgtatactagtttttcatggaatgttctgtttaatggacataattttgtccatattctaatctttttcatgtataaacataaacattttaaagaaataacatctgaggaaattgtatgacaccagaaatataatattgaagtaactttcttccaaaaccagttgaaactttaaacttaaacagaataatccaacctctgactttcctatcaccatcattgatgtttatttactgatattccagatttgaacataattttaagcttgtttatacaataaaagaaatttttgttattgaatgtactcaaaaaataaagtatagatgctgtgaacattcttccagaatattttatacatagtttaaagaatccttatgtaacatttgctttgtctaactcactggaagtgggactttagaaactgggcctctttgtaactagatccacaaatgtcagtatacagaatgtgagccctcatgacagactgaagatgaattcaaaaactgttagaaataaaacaagaaacaaacctttaacaattttaaaaaagatttttccaaaacagcaatgctctttcctaagtaagacttacttttgattcttgataatgtgaaattgtgggttcagaacatcaagggaactgttggaagatttttatacttgtcccttgcttgattttcaatcctagaccatgttaaatggagctcaaatattagtcctgctggtttctgttactgtgggaatgaattttctttttctctttttttaattgttggagtatttcttatccttaaccaccctcacatctcaaaccaccctgtggtttgtctgacttccacaggcagattctgaggcaagccctgatgattgcttcaagggggagtggtattaggggaatttgacccaaagtctccaaataaacccttttttttcttagtactcatgtgtgacatcagcttctaaatatgcagtgtctttgttgttcactaataagtttattttaagagttgtgtttcttttctcaccttttgcaaagagcatcttaaaatttgctgaaagatgagagactacacacacacagtgtaaaaagtggctggtcctttagtcctatttccaacattgccacaataattttgaccttaagctatgcagactagtgaagtggtgggtggggatgcagtatatgtggtatttaaaagtcataacatttcagattatttttccatagtcaaagattagcccctgtagtctaaatagcagagatttaagggctacttctatagtggaatactataaaataatcaatctggctaaatgtagatgtcacacattcagtggaaaatttatgcaattaccacaagtcatgcaactaatatggcatatacagtgtatattttggtcagaaataacacgaaaattgcccccaattacacaaaggcattgagccacataaaataatgttctgcaaaaatttgatttggcaatacaattttttagaaacaatattacccctgaagaatgtcaaatgttttaaagctattttatcctcgttccattgatttcaaatctggctagaggaaattgacttctgttttggcaaaaacagaaatctcctgagccaacatcattattattcaaagcttaattcagagaccataatttgctaagtctattaacaatgaaaacagatatttatggaactctaaagaccttgcatataaatgttgattgtttcatggattatagcatgcatacactatgaagagatttaatttttactaaatgcaaaactaaaatgtttcaaatattgaaatagaatttaggtgcaatcattgaacggtgcaatcttttgtacagcaaattttctgctttccagtaaaataatatggtttgtattttatgttatcaatttcaatatggttgatttcacaataatgaaatgtgaaatatctgtttccaaaatgatgtcacggatagtcttagcatacatctctattcttatatctaataaatcagtacatatctggtttagatatactaatcttagaagttaattgacttttccaaaaaaataatcttcagattgaagtattcattggttcaaaaatgtataatgaccagtgcaacttgccatattattctaggaagcaaattgattccccagagattttgagaagaaatgaaattatttagcattagtttcaaactttttagtccctttaaaatgcaattttagaagcttttgttttagttatttaaaactgttctatatttttccattactatatgtactaccaaaattgtatgttcttcatataggaatgcaggacaaaaacatggaggccaagtattgtattcaaaagagatactctgcttataagagaagtcagagaagatgacattggaaattatacctgtgaattaaaatatggaggctttgttgtgagaagaactactgaattaactgttacaggtaatcacagtcttcaatatttcacttgcaagtgatgaaactactattttaagttagtttttatgctacacattgatatttttactctctaaagaattacataatcaaatgctaagtggattcctataggtgaaatttattcctccttgcttttgaatcatcttccactgaagtccattcaaaaggctagagacaatatgtttagggagttatagaaatgttaacttttgggccgggcaccgtggctcatgcctgtaatcccagcactttgggaggccaaggtgggcgaatcacgaggtcaggggttcaggaccagcctggccaacatggtgaaaccctgtgtctactaaaaatacaaaaattagccaggcgtggtggtgggcgcctgtaatcccagctactcgggaggctgaggcaggagaatcactcgaacccacgaggcagaggttgcagtgagctgagatcgtgccattgcactccagcctgggggacaagagcaagacgaagtctcagaaaaaaaaaaaaaaagaaatgttagcttttgaaagtacttgaaataaaaatgagtttatggtttccaaaaattatgcttatattttataatggtatcgtttttggaaacatttcctagagtggctaaatagaatatatgaaatctacctctgtcttcctgtcttgctccaaattagaaaagtcgcttttctcttttatttatttatcactctatcaatctgacatacatgtcctcatgaacttgaaaatagcataacttcaggtgcagtcattgaataattatgtgagatgtgatgcatagagtcattttcatagctggttgctaaggtggaaggacatgaggacaagattcagaacactacctgtaatcatgaatctacaactcactagtcacataggttggtggagttaccacagccttcagcatattagtttcttcatgtataaaatggtgttgataaaatttgctgttcttatttcatagggtttttgcaaggatcaaatgaagtaaggtaatatgtatgacataaatttgcaaaatgcagaattatatccaaatgtgcataatttttgtccatgaaaattgcattcatacattttttttctttatagtgcatttcttacaaggtggtttcatgagaaaagtggggataataagaacaacattcagaaattaaaaatattattctcatattcttattgagagattcttcttggtgacttttgtgtatgatcatacttgtaaaacttatatagaaaagcataaaaaggacattagctgttttaaattaaacagagttttatttgttcactggtccacttaaaattagttttccctgtatatgaaaagtgttttgtggtagtcacctacatcttataataatttatttcttttaaggtatctggctatacttgagtttctatacaatcaattttgaaatttgtttttcatctgttacttaattttttcctttaatctctactgaagtggtttttcaaccagtagtattgaggcaaaggaatttaaaaatataaagtaaagcaatctatcctgaatagaaaatagaatgcacttctagtctttattcttcagagtggagaactcatctttagtaagcacctctttcccctttctagaaatgctaggattctaaaccagtacctagtatgagacagttggagcacagtatcatggatactgaacactgggctctgaatggtaaaacagcttgtgtaagactattttatagaaccaaaaatagaactctttatatcctaaatgctttccagggcaaccgtactttcctaaacttcatttgtcccaaaatatcttgttttctttatataaaaacaaagagtaattgagtcttgatattcaagaggaagataaagttttaatgaaagttttcattccacttattatcataaatacttatatgtagccttacctgagacaatgatttgggcaaataaattatgaaacagtttgactggatgtgaaattttgggttaatgtagagctacatgccctagaattaagaacagtatatactaaaatgcattttaggtattaacaacaagtctactgggaagatatatttatgtataacattgttttaaatggtgtgacactatagcgcatttactgtggggccaaattaaagagcagttcttaaaacccaaattatattcctcagttaaagcaacaaacatgggcagtatctgaatgataaggaatcactgttttttatcttggttttctgcacatcattatcatattttacttaatgaaaatattatggaaaacataatattatttggttttagtggaatttgaagtttgttataatgtcactttaaaaaaaaaaaaaagaggaatcctatacgtaaaaaggaaatttctggccgaaggaagtggctaaatgtgcaggcagcatcgtgagcttttatgggtgatcgatccttcccttattgaaaatgtatatccttagctaagtgaagtactggttcaacaaaacagatcacagtgaaaggaattataaacctgtccagcacttttggtattttaaacatctttttttttttctttgggaaacagtttctctcttgttgcccaggctagagtgcagtggtgcaatcttggctcactgcaacctctgcctcccaggttcaagagattctcctgcctcagcctcccgagtagctgggattataggcccgtgccaccatgcccagctaatttttgtatttttagtagagaccgggtttaaccatgttggccaggctggtgtcaaactcctgaaacattctcaatttttttcttttaaattaaagatgttacggcaccatctctagcctctatcttttattagccttacccacattgaagttcttactccaaatgtcctccctctgaactcttattcatggttttctccctctggaaggttttttatcttctcctttgtcacatccctgattctcaccctttcttcaaggcacagctaaaatgttatccccttgttgaggcacgtactccatgcatccacagcacttttagcatctctattgcagcacttacctcattgcatcaaactatttaatgacactcctgtattttcataagaatgtgagcaacttagagtcaagggcaatgtcttttattttttaaataagcatttgattttagaacggttttagatttacagaaaaaacatagtagaaatcccatctagcctgcattcagttccccctgttattcacatctaatattaatatggtatattcgttatagttaatgaactgattttggcacattattattaaataaagtccgtagtttatttagatttctgtgctttttacctgatgtccttgtttctgttccaggatcccatctagaatagcacataacatttagttgttatgtctccttaagatactcttggttgtgactgttttacatttttttttatttttgatgacctttacaattttgaggagtattttgtcgaatgtcctatatttgggatttttctgagattttttcatgattaggtgagggttataggtccttggaagaaaaaacacagaggtaaaatcacaacatgtcatatcagcctgacttatcactgttgatgttgatcttgatcacctgaggtagtgttaggtaggtttttccactgtaaagttactctcttccccatttttatactgtagtttttgtcatccatgctatatgtcatccatgctaaaggagtgagaggttatgttccacctctctgagagcagaatgtccacatattttgtgtggtattctgctacatgagatatatgtctgttctcccacatttatctacttattcaattgttgctctataccagtttggacttaacagttattttatactttgctttataatccaaattaccttatttattttgttgctcaaattattacagttttggtcattaagagctcttttagttggctcctttgtccctgtgacatacttatattggggtgtgtgtgtgtgtgtgtgtatgtatgtttgagtactttcctactttctggccctttaagatgctctaagctcatcttgtatatttcctgccccagtccctacatcagatatattttttcaaagatgccatgttgcttttattggagaattataccaaaaatgaataccttcatgttgagagtactcattgctactgggatatagttgttttgaagcttttctaatcgacaaaaaaagaaaaatgtgtatagtaacacataaacatatacacatatctatagatatttatatgtgtaaccacctgtgtttatattaagttaaacatgagttcatactgatgtttccaactctaatttattaccatatggatcattttagcctcttcccctaccttatgtgtaacctcccaatccagtagttagaaaactggttctcaccatctgccattcttttactgaattgttcacttccagtataaatgtatagtgagatcagaatttgttaacctgtgcccatgtgggaaacaactttatcaattagaatatggtgtttacgtacaattgttttagcatttagccttacagacttcactcatttccaaagttgctaaggtcagcacctttcccctcacctgcttcagtgaggttatctcacatatttgtaatatagttagattgttttatcatattctgtatttcccaggatcctctgacctcctgaattatatttaaaatttgcatacattaaggttttctctttgtgctgtgaagttctatgagtttaaacaaatgcatagtgtcatgtattcataattaaaaagtaacagaatagtttcactgccctaaaaaagactctacacttcatatgttcagcccttctttctgccttccgaatccctggaaacaactgatctttttaccataactatagttttgctttttccagaatgtcatataattgaaatcatacagtttttggccttttcagactggcttctttcacttagcaatatgcatttccttcactcctttctgccttccttccttttaattgagcattttatctcttccatttttacatcaattttccttctttttagatatatattttagtgatagccctggatattccaattttaaactaatctcagtccaccttcaaaaaacgctgtgtagtacagataccttattacagagtactcccagttcctctctcctatcctttatgacattgttctcattcatttcacttacccatattgtataatcacccaatatattgttactgttattttaaacaaagttatcttttacatcaatttagaataagagaaataaaatattttattttaccttcatttattccttctctggcactcttctttatgtagatccaagtttctattccatacacttttcttctgcctgaaaaacttcctttggcatttcttgcaatgaaggtccagtggtgatgatgtcccttagttttcatttatcagagaatgcctttatttatttttcccctttgaaaaagaattttgctggatatagaatttttttgtttgtttgtttgttttgttttgttttgagacggagtcttgctctgtcgcccagggtggagtgcagtggcatgatctcggctcactgcaacctctgcttcctgggttcaagtaattctcctgcctcaccctcccgagtagctggaattacagacacgtgccaccatgcccagctaatttttgtattcttagtagagacggggtttcaccatgttggccaggatggtcttgatatcctgaccttgtgatccgcccacctcagcctcccaaagtgctgggattacaggcgtgagctaccgcgcccagtctggatgtagaatttttgattggtacttttttcgttttgtcactttcaatatgccactccactcttttattgcttgcatggtttttgatgagatgttcactctgatacttatctctgtgcctgtatagatatgatattttctctgtgttctttatttatttatttattttttttgagacagagtctcgctctgtcgcccaggctggagtgcagtggcgggatctcggctcactgcaagctccgcctcccgggttcacgccattctcctgcctcagcctcccaagtagctgggactacaggtgcccgccactaggcccagctaattttttgtatttttagtagagacggggtttcaccgttttagccgggatggtctcgatctcctgacctcgtgatccacccgcctcggcctcccaaagtgctggaattacaggcgtgagccaccacgcccaggctctgtgttctttcaagattgtctgtgttttttttttctctgtagattgaatatggtatgcctaggtatagtgattttgttatttatcctactcagtgttttatcagcttcctggatttctggtttgatgtctctcaattttgaaaattccatgaccattattatttcagatatttactctgctccattctttttttttctacttttgatattccgattatacatatattatgccttttgaaattatctctcagttcttggatgttcttttctgtttttatcattcatttttctctttgcatgtcagttgataaagttctactgatctattttcaagctcacacattgtttcctgaactggtgtccagtgtactgatgagaccatcaaagggcttcttcatttctgttacaatgtttgttttttaaaaactctagcatttcctggctgggcacagtggctcacgcctataatcccagcactttgggaggccgaggtgggcggatcacaaggtcaggagatcaagaccatcctggctaacatggtggaaccctgtctctactaaaaatacaaaaaattagccgggcgtggtggtgggcgcctgtagtcccagctactcgggaggctgaggcaggagaatggcgtgaacctgggaggcagagcttgtagtgagccgaaatcgcgacactgcactccagactgggcgacagagcgagactctgtctcaaaaaaaaaaaagcaaatctagcatttcctttcgattctttttaacattgcaatctctcttcttatattacccatctgtgggtatcgtggaggaataataccctccatacagatctcacactctacttttattaatatttaggttggtgcaaacataattgcggtttttgccataactttgcgggtttttgccctggaaagtaaaggcaaaagccgcaattacatttgcacgagtctaatactaccgagttttacataaaccttttcatttcctacattatattgctgatttgtattgagatttaagtcaaataacatcagttttcttatattgttaagtcaaatgcctgcctgtggttgaacttttaggtatgaatacagtgctgagtattcctatagagatgattatgttcatttttaatacgtcatcccagtgtatgaagataggttttatacttgattctgtcttacactataataacttctcttccttgacaaaagtcattacgttttttgttggaagatatgtctgttttgaatggaaacattgtttaaaatgttatatttaaaaggctctgtataaagctgtgtaatatgcttttatattttttctggaatgtattatttcacctctctttagtgagagatttttatcctaataagaaatacagaatccagtacatatttttacttatttcttttaataataacatatataaccaaaaagtgtataaaatgtaaacaagtagctgcttagcatgctatcaaaagaactcaactaggcaaagaaatagaatactgtaggccccatagaagcccccatatgcccttctgattataaaccccttcctctccactactggataggtacctcagtatgtgagttttggggtatttattttcttgcgtgtttaaaagttgtattagctgatagtgtatgacaaagcgatatagctacattttgcctggttttgaaacgtataaattaggacccacatgttgtgtattctgtctggcttcttcaactccaaattttgtttcaaatatgcatgtatgttattccattcatctgtactttattcattattcttatgctatgatattccattatatgaaaatctcagtttgttgatagacattagggcttgttgtaattttttgcttatgtaagtaatattgccattaaccgtcttatgtacacacatatatacacacaaacacttacatatttccttgaacatataagcaagcaattctgtaggatttttacctaggaaaggatttgctcattaaaagtatgtatattttcaaatttactaactattgtttgggctaatttgggtcatgggcgtatcctaaccgaattgactgtagggaggagagaagtactccaaagaaagttggaggtgccaaaataagtggaaattattctaaggaacataaaaagccattttctactacttctacacattatgatttcttaaagattataaaatataatttgatatgcataaaattctgttttgcattgtgtaacaattttctatacttccatattgttaaataaaaatgtgaaaacattcaactttgtattgatatacattgccatatcctaggattccttgcactaaactctaactcacatccagactacactataaccctagtcttctgccagatatatgtgggaatgtgggtatggggaaaacgtcatatccagaggtggtccataagcaatctagtgattccaaaataaattaaatcaccttggctcatcataaataccaactatgtagacaaaaaatacaaatattagtaatgatacatatttttggatttgttaggtctaaggaaaaaaatatacactatataggatttttttagatgtattgattacattacatgattttcatttttgcccatttaatgcttatttccccttctggccaaaacatttttctattattttaaaaagaaagatttaaaacaaagtaacaactgtattgccatcataaagtttggaaatgagtcagaccagttgcaacaccatttaatttctagggtcagatcatagaattaagtaatggtaagggaataccttgttaaaatgttatgtcagaaaaaattttcccaagtaaatttgagagtcagcaagcagagtgaggaagtgaagaaaggaaaactgattcgaaaagaagcaaaaagaatgaggtgattgttacaaggatgtgatagttttagtagcatttttatcctttatataactttttaacagttaatacagcagaatattcaaactacttcccaatcgaccacagactgaatttacgctctcaaaaggtacatcttcctcctcttttaatggatgaggaagctgaggcaaagaaaggttaagtggctttatcaaggtcacaaaacgtcacagtgacaaatttagaaataaaatttaattccctgaacctcagtctatgatttactccactggataattaatagcaaggcattgtagtgttcatattagctctgctgatcgctatgagagatttatattttaagtgcaacggaaacacatttaactgagacctctaattcttctgccatggatgtaattaagcagtgtatttgtggtctagcctggggatggagtattgcttctttttcttcctatttctttcaaaaaattgcgtattttatttctcctttaaaaaaactgtttttgttaaattacttcatggattaaagtgtgctttcactgactacagcctaacaataattgatgaaattgataaaaggggcagatctttccagactttactttgtatgtttgctaacattccaggatccatacccacaaaaaccatcatgtatattatttttgatgaattgacatatactacatttctagctgttttataagtaaatatctgccatatttttgtaactcaaatatcatttagattaattcacacttttgaattaaaagagaaaaatgctcataaatatggtgaaactgaatttaatcaacttggctatctaatgttgatttggagttgaattcctaaaacaaaagagctctttcatgagtggtttccaataactgtcctgaaaccactgacactcattacctttatttattatttaatcttaatatactaaatgggttgttcaaaaatgtatgaatcaaattaacatttattgttaaggtgtagtaagtttgaataaaaacaagatgtttttactcttgagcagaaaacgtatacattttagaacatattcatagcaaggttggaatgtgccatctctggccatggggaaaacaagacatcataaacttgaatgatttccattaatacaagaaaaattaaatattaataattagaatagttaacacctactgagtgttcaccgtgtgccaggatctgttctaaattctttttttttttttttttttgagatggagtttcactcttgttgcccaggctggagtacaatggcacgatatcggctcaccacaacctccgcctcccaggttcaagcgattctcctgcctcagcctccccagtagctgggattataggcatgtgccaccacgcccggctaattttttatttttagtagagacgggttttctccatgttgatcaggctggtctcgaactcccaacctcaggtgatccacccgcctcggcctcccaaagtgctgggattacaggcgtgagccactgtgcccggcctgttctaaattcttccacataacctcaacttactcacccttaaaaatttttccagtgctcgccaggtgcagtggctcacgtctgtaatcccaggactttgggaggctgaggtgggcagatcacaagatcaagagatcgagaccatcctggccaatgtggtgaaaccccgtctctaccaaaaatacaaaaattagctgggtgtggtggtgcgtgcctgtagtcccagctgctcaggaggctgaggcaggagaatcgcttgaaactgggagatggaggttgcagtgagccgagatcacaccactgcactctagcctgggcaacagagcaagactctgtgtcaaaaaaaaaaaaaaattccagtgcttgccaagtacctaatattcttctaggtttcataaattgcacttgaaaataattcactattttatttcccacttcatatggatttttgaatttaataaaagatgaacatccatttctggaaaatgcagtcaattagacctccatttgctgctctgaaacactgagaaaaattagatgaaataaaatagaaataccattttaaatgattagttgagcttgcaagaatgttcttttttaaaaaaagaaaaatctctgggtctaatttttatttagcagtattgaagtacaaaaaagttacataattcaaatcataattttatgaatatcaaatcacattttataatctttaagaaatcatgaagtttagaagtaatagacatctgctgtttatatttcctagaatatgtttcacttcttttgacacctcccattttctttggagtaccactcctctctttccttcagtccttttggttggtagactcttggtcaaaaaaatctccaatttgctgctcaagaagaattgaccagtctccaggaagggccttaacagggtcctcctggttcaagacagcatttaaaaaataaaaagagaccaggctcagtggttcacacctgtaatactggtgctttgggaggctgaagcaggaggattacttgaggccaagagtttgagaccagcctgtgctatatagtcagacattgaatctatccatacatacatacatacctatctgtattatatctctaaaaatgtcaggtactagaatccataaatacagactagaaattagctatgcctaaaatgatgggtcacatttttaaaaatctaaaacaataccagtatttttgatgcctgtgtgagagcataaatattaagaaaggcaattggtcagcaggactttctgccccagtcatatatgcattttgatttcattcaattttctggctgccctattgctgttgttgcctgacatagttcatcagccagaagtagttcttaattttttcactgattttctttgacagcattgaatttcaagtgtactgagagtgttttcattataataaccctgccagtgtaatccaacggattgcttgcctcttagaaatgatacagtcatcctttctgtccgtcccaggtgttagagctgtattacttctagattttcagaccactagctaaacttattcttacctcattgttaaagaaacaactacttttttttttttttttactgctaaccatatggcaggtactgtacacaattatttataggcattactatctatatttatcaaggagaaaagtcaaagtacattttggacacatatttaaacttttaaatacaaatcattatcattatttctaatgaaattcccttctttatttgcactctactgcttcaaattttcaaattctcttatattaattctaacaaactcaattttgagagtcaaaaagctgttcaataaatatcccttgatagaattattggtttatggctgggcatggtggctcacacctgtaatcccagaactttgggaggccgaagtgggtgaatcatctgagatcaggagttcaagaccagcctggccaacatggcaaaaccctgtctctactaaaaatacaaaagttagccaggcgtggtggtccgcgcctgtagtcccagctactcaggaggctgaggcaggagaattgcttgaactcaggaggcagaagttgcagtgagccgagatcaaaccactgtgcttcagcctgggcaacagaacaagactccatcaaaaaaaaagaaaaaaaaaattcttgttttagttagttagagaaaaaaaatatcaacaactgggctgtccaatataatagccacaagcaccatgtgtccactgagcaactgaaatttggctagactggattgagatattttaaatgtaaaatatgtgctaaatatttcaaatgtaaaatatgtgctggattttaaagacttagtttgacaaaaataatgcaaaatatctctttagtaatttttttatattgatatcatgttgaagtgataatatttagttaaataagatatactacaaaattgattttacctcttttcacttttttaaatgtagctgctagaaaatttttaattgtatatgtagttcggcttatatttctgttgcacagagctactcttgaaagtgaagtgtggtatcagcctggagaagtgtaagggaaacacacaagaccaagcatctaagggttgtcttagttccattggtggagctgccatgcctgggctcagtgaccttaactaagttatctgtcttcattaaatgttgtcttagtgttgagactgtgaatagtcatcactcacagtgctttggtgaggggtaaattagcgcagatgcatcaaaccggactgtgaaggaatatacaaatggaagtggctactgccatgatttggtttgatttttgaatctttaccttggtgatatggtttggctatgtcctcacccaaatttcatcttaaattgtagctcccataattcccacatcttgtgggagggaccccgttagaggtaattgagtcatgggggcgggtctttgccatgctgttctggtgatagtgagtaagtctcacgagatctgataggtttagaaaaagggagttcccctgcacacgctctcttgcctgctgccatgtaaggcaccgctttgctcttccttcatcttctgccatgatttcccagccatgtggaactgtgagtccattaaaccgctttcctttataaattacccagtctcaggtatttattagcagcgtgagaacagactaatacacgtggtttgtttcagttaatgtaattttaatatttataatcttttttttattattatactttaagttttagggtacatgtgcacaacgtgcaggtttgttacatatgtatacatgtgccatgttggtgtgctgcacccattaactcgtcatttaacattaggtatatctcctaatgctatccctcccccctacccccaccccacaacaggccccggtgtgtgatgttccccttcctgtgtccatgtgttctcgttgttcagttcccacctatgagtgagaacatgcggtgtttggttttttgtccttgtgatagtttgctgagaatgatggtttccagcttcatccatgtccctataatatttataatattaatctattccgtcaaatgtcactgattatcatcaatacaattattgactaacattcattgaccattaagtaatggtttatatgtgtggagaaaattcagaatatcttatttgtgtgcaagctactaacaaatgaatttcaatgtctttaactggggtaaataatgaatatgtgcatttctacctttgatatgattatatatatttatatgtatacaaatgcatacatacgtatgtatgtgtatatatatgtgtgtgtgtgcccctatattaatatatgtcttattgactattacagtcacttatttgcatctaagaaatcaggggaacatttttctatacttttttttgcaataatattattttctattttacaaaactgatttattttttgtggttaacattccaaagacccatttgatcatgattcctctcatatgaggtacctagaataggcaaattcatagagacagaaaatagagtagagattattaaaggttggggaacaggggaatgggaagttattgttcagtagttagcagagattcagtttgggatgataaaaaaaagttcaagagatggataaaggtgatggtagcacaacattttgaatgtatttaatgccatttaattgtacacttaaaattagttaaaatggtaacttttatcttatatatcttaccacacaaaaaaagattcatttgaaaataaatggctgttcttaatagtttggagcatatttttaaaattatttgccaagtgtggtggcttgcccctgtaaacccatcactttgggaggctgagacgagaggaccacttgagcccaggagtttaagaccagcctgggcaacatggggaaaccctatctctacaaaaaaatacaaagaattagctgggcatggtggtgcatgtctgtagttcctgctactcaggaggctgaggtgggagaatcgcctgagcccaagaggtccaggctatggtaatgagactctcactcaaaaaagaaaaatatcatatcaaagatttttttttaaagatcatcttttctctacttcatgttggctctctactttgacaggtattgatttttctgtaaaacttttgaagctcaaaccattatgtcggcactttatattaactgcttttagttttgacatcagcaaaattgactgaaaactcaatattgcacctgtttcaatacagagtctctggtgtggaaagattagcaagataagctaaagaaacttctattgttcaactttatcttctcagtctcatcaaatcaaagattgaaaatgtactctaggaggatgtatttctggtgaggttagatgactacacatctaaaagtaaaagttttaagagtaaaatataacataataaggatctagaatcttgaagaaagattccaacatattttatgacaattaagtctctaggtaccattaataaagatgactgtaacctcagagctaaaagcatttagttcattattccatgcaaactcgttaaaatatgaagactaaacttagcatctagtgtcaccactaaaaactgtttaaaacttatgtgatattgagtgagatacatttctttatggtttaataagtgaattagatgtctcagtgtgatgatgcctatatctacatgcacgtgaatgtgtgtatacatagatctatataatatatatctataaatatgtattttcattggatagagaattattaaccattttgtttttttttttcttttttgagacagagtctcgctctgttgcccaggctggagtgcagtggtgcaatctcggctcactgcaacctctgcctcccgggttcaagtgattctcctgcctcagcctcccaagtagctgggattacaggcgcgtgccaccacgcccggctaattttttgtatttttagtagaggtggggtttcaccgttttagtcaggacggtcttgaactcctgacgttgtgatccacccactttggcctcccaaagtgctgggattacaggcgtgaaccaccgcgcccagccattaaaccaattttatatatacagctcttatagttttaattttatttttgccacttagtggcaagaaatttgttacttggtataaataaaaccaagttgatttgtttaagcagtaggttcccattagacttaatgatgttgtatcatcccattattaatttgaataaatttctattatgttatttttcaaaatgaacaacagtgcatagaatcaacaattgagtcactgcaatagcagtataaccatgctactccttcaatatgggagtttttgttaacaaactaaactctgacagcttaatgtatgcaagattaagaaaaaaaataaaaccacaagctaatttcttattatactcactttgtgtattatacttaatggggtctcagatttgtttttcttctttcctagacaccagattaccaggaacagtgagaacttaggtagaaatgtggataatggtacactaataactagaggtttacaaaataggaaaggttaaaggaactgagaatattactattatttggattttaaaaaactctgggctgggcgcattggctcactcacgactgtaatcctagcactttgggaggccgaggcaggcagatcacctgagatcaggagttcgagacatggtgacaccttgtttctactaaaaatacaaaaattagctgggtgtggtggcacacacctgtagtcccagctactcgggaagccgaggcatgagaatcacttgaacttgggggggcagaggttgcagtgagccaaaatcgcgccactgcactccagcctgggcgacagagttagactccgtctcaaaacaaacaaacaaacaaacaacaacgaaaacctcaatgatgtgccataataagatgttaagtactggaagtgttcagaataatggaagagcagcaaagggtgactacattaaaaatccagcaggtaatgagtttcatgaggatttacaaattgttttttaaaaaatattgattaaatttattgctctgtgattttagcatttaaggatagttcctggaaaaaacaaacaaacaaaaaacactgctcaataatagggaagacttttggtgctgtattctttggaggttttaaaaatatgacagaaacccatttgaggcatgttcaggcatagacaaattggaggaaggtcactgagactctagtaatttttttattatgttaaaatttttatggttcatttttcctaatattttgtagtttaaaaaatagggagcaatttaaaaaatcaaaacattaggttttgatatgacagtttaataattacataaaggaatttaaaataatgaatgctatttttaaactgttcaaactattttaaagagcttctattactcttacactatgaaaaggtccactaattatatcccagggttagttttcccttgcctttatcacaatattgaaggctctttcttgatgataaaaccaagaggtaactcttaacttgcaattgatgtagatattttgtaacatatatttagaagaatttctaaaaactatttttgagaaaactgcatgaaaatggagttggtttttttcatgtcaaaatatataacttttgcatcataagagatttaatgttttcatttcttaaaatgcttgaccaagtcttttagtcattatattagcatctcttgttccatctggaggacctaaaaatccaatgaactgtaaatgggcagttcaatatgaatatgcaaattaaagacattatgaattctatgtaagatgtaaagaagtagcttactctgtgccttaattagaagaccttactgtatatttctttatcatttgttgggttgatcatcgggttccactccaacatatccaccaggaattctggtatataaatggcatcaaagattgtttacaaatatcgtggacaatgtctcaagtgataattgcaatatgtttctcagggaagaaaaaaatacaacttttgtgaatattatttttaaaacagaaatgctgtatatagtcactactgtcttctgatggtaatgatagaaattttggaacctttaatgagtacttattgttaaagttccattagataattatgttctgtttacatactgccatcatttgaagaacatatttgctttattcaccaaatcttgaagcatactctacacatgaatttaaatgctactatttctattacccaccctcagagtcttctaatttctaatatttacttaaatattttggttttcaaaattttacctatgattataaagcacacactgagcttttattttaaaattgaggcttgtgctgtcaatttaaggatgagagaagcacagagaaacgtgttctttttaaaaaagtaatatatatatatatatatatatatatatatatatatttttttttttttttttgagatggagtcttgctctgtcgcccaggctggagtgcagtggcatgatctcggctcactgcaacctctgcctcccaggtttcaagcgattcttctgcttcagcctcctgagtagctgggattacaggcccacgccaccacgccccactaatttttgtatttttttagtagagatggggtttcaccatgttggtcaggctggactcaaactcctgacctcctgatctgcccacctcagcctcccaaagtgctgggattacaggcgtgagccactgcgcccggccaaaaaaataaaatatattttaaacctttaaaagcaaacttggttatcaatgtatcatgtttctgtgtatcaacttttataagtccactactcaaaatgtaacctgaaaacagaatttttccaattagatattgttgctatggcgtaattgagctagttaatgatataactctttcagaataataagtcaataatagttatcagcaccaaacatgaaggaagtgaagtagaagatatatgaaaaataaccattaatattaaaacaatatattatgggggcagcaaataggtagtaagctatttactattcattagttggttatgacattgctaaaattaaattaaaacaaaaggtgaatacaaatacaatgaagtagtttggatgatgttttccatttggggtatataatcagatcattttatgttaatctaatttgtctttgagttaaataaacccaatagtgttgacctgccttttcatgtgtcattttttcaacattgtcgtttgataaacatttagtaagaaataaaattacactcagagcaataattttatactttcgcaagctatttataaaatctaattgtataaatgaatgtgttctttaaagatctgtatttgttgtttatgatgaagttaagaagttatagctacttctggtgctgttcaaaatgaagattggaaataatacagtgaagtagatctttaacccagatagtttgagatgcactcttctggatggcggatgaaggactgaaacaaaggccaggcagttagtttgcagaaaagaaatatgtaggaagtaagacaaaataattaattacatatacgtaatgacatatacttcttctcattcaaataatctctagtcattaattccaggaaaattactcagataatttttttttttttgagccagagtttcgctcttatcacccaggctggagtgcaatggcatgatctcggctcactgcaacctctgcctcccaggttcaagtgattctccagtctcagcctcccaagtagctgggattacaggtgcccaccaccaggcctggctgatttttgtatttttagtagagatggcgtttcaccatgttggccaagctggtcttgaactcctgacctcaggtgattcacctgcctcggcctcccaaaatgctgggattacaggcatgagccaccgtgcccggcctactcagataatttttaaaatgtgtgctttttttgtttgttcataacattcagagttctagagcataattacagagtatttcaacaatgctcagttagtagtggttaaatcttccacttcagtgcagctgttgctctgtcatgtaaacataccaaatgtaccttcaataggagtttaagattttttttatatgtatttctgtactttggaaatagtttctagtgggtgggtgtggcagaggagactcttgttggttagtatagagctgttgctgtggagcagctgctcagccagaaattcaatttcccagcccctcttgcttctaggtggaaccatgtgactagttcttatcaatgagtataagggaaggaatgtcatttctgagccaatgtaatgacgaagtagatatgctttttccctgtctttctttctccatcaattactggatgcagacaatggcaaggttttaacagatggaaggtgcccaggtctctaaatcacataatggggggaatttggtcactgaccagaaagactgtcattgaatgacttcaggagtgaaaaatgagtctcagttaaattaaatcactgaaatggtgaggtttacttgaatggcagaaagccttaccctaaatagcagtgttaggcaagttttaccaatgcaaagtcatttgaataaaagagaaatttattgtaaagtcacaaatggtctagaactgaaactgctaagctacacagctgccactttcctgtttgaatgcttctttctacacggtttctccatctgctatgcacttaccagatctctgaatgttcagtctatacatttttcaacagccaaatcaaaaacccatctcttctggtcaaccttcagtcctctctcctagatctggacagtcccattttccttagtggtcagtttgctttttgacacttttttctttcccctccacagtgatttggccaattggatatattcctactctttcacactagcctgtaaggccctcgagccacgactttgtcttcagcattatttagcatagagagaaaagatgattaataagtacttttgaaatgtttaataagcaaaagctgagttgggaatgtattttagaaatatatgctattgtagatagctaaatgtgattttagtctttatcacaaacttcttagtaattatttgagagctttcagcatatttataaaaataatttaaaatataactattttacttgaaagtctttgtatattcattgttcttgaattagtaggtaataatcctaatgagccataacaactgttctctcttcaaaataattctgatgatagggttttcttcttaagtcagcacaaaatttattctttatatagggtcaattgaagtgtttttaaaagcatgcacagctctggtaattcattcataaaacacaggaaaatgttttaaagtcaaaagcttcaaaaagattcacaatgtgaaaaacataaattagaacattaaggaaacttgtgttgtaggactttttccttagttcagctagaaaccaggttcttgtcacatgaccaggaaagattaggttcctagacacagtagaagggtgggaaaaatggaatttattgggcaaaaaggaaaaaggaaaaacaacacagcaaagtgagatggggtcctgctaaggggctctccacctcaccaaacgaatcccagggttaccaccccagaacaggagaggccaggctcctccccgctgcaaagggcatgaacttccctcatctccacactcccacacatacccccacccctgttctcccagtttgcaggccagttgtaggttctccaagaacccctttctcctttattacttggctgtctcacttagaagactgatgctagcaaaaaacatacacaggaaaaataagagagtaacagaaaaaaaaatctggcaaagaaggcagaagggaaagagactaagccataagagagagagagaaaaaaaaaatctctggtctgggaagggcatattttctaagcattagtgtgtaagatggagaagcaactcattaagctgtcctttaatgtagtattatccataatagtacaatatgagaaacaactcaaattccccaaaaatgatacagaatggattttataaatcacgtaagccagtgccatagaaaagagtctgaattcgagtggtgtgacttcagttatagtcctgtttgcagcctggtacaggacttaggcaaatattttaattcttacttgtatgtttgggaggcaaggtaaagacttcgccttcaccctctgaagataccctgaaaaatcaactcacagaaagcagattaattggaaaaaagacatatacatttattaacgtgtgcatgaggagaaccagggtggttacccatcttgccagtggagttcagaagcttatatgccatcctggtcaaacaggttatgggagtggagagaagaggaattttggtgagggacaataaaggatccttagggagaacagaacccatctgggagcagagattaattaagttgtaaatagttctctttggaatttgaatgagcctgagagacaggttagtcttccacagaggggaagaaacaacagttatcctttttggtgagtttggactttagacatataaaagaacttcaaagaacagcttcctcctggcttgagagagtcatttgcgggcggggagagggagggaatcagagaggctatgagactgctttttcagttcagcatgttaaagtgccatatttggggtatcggtttttgaaccccatcataggctacagaaccctacagttcctttcaaggctgaaagtttctaatacagtaaagtgtttaaaagtttacactattctgattttagcagatttcccaaatggtatatctcttcatagtgttaggtaaggcagaaagctattctttaaagagcaaatctctgaaagctaatgatgcctgggttgcaatctaaatgatatttttttctttttctaaaatgccaagggcaagttgacttttagagttaatttctttcatttatataaaatggtaatgagagttaaattatatttaggcacctggtacattacctagcctgtaataaactctctgtaaatgctagtttcctccctctgttgcattaaaacaactacaagatgaaaaacctatgtaaaccaaaaataaaagtctaagccccacaaccaacagaatggacccctcctttcggccaagagcattataaaggaaacctgaaatattagttcaggccttgatgaaatggatggttggatatgcctcattatactttcctccctttgatatttaggctaaccagcattagcattaaaacagagacctgaagactgacagaactagactctttaagcctgataagaaacatttacaactgattccctctaaagcctgctacctggaggcttcatctgcataataagaatttgggtctctataatcccttatcttaacccagacattccttctattgattccaagtcttagataaattctttccaccaattgctaatcacagaatctttgaatccacctactacctggaagcacccccacaacacacacacaatggcttcaagttgtcctgcctttctggaccaaaccaaagtacattttccatttatcgatttatgtcttttgtctccctaaaacgtataaagccaagctgtagcccaaccaccttgggcatgtattgtcaggatgtcctgaggttgtgtcatggacatgtcctcaaccttggcaaaagaaacttctaaattgattgagacttgtctcagatactttttggtttacaactgaaaacaatataggttagcgatacatctattctggtgtcaacgccagaatagtttgtcacagtcaaattttattactgtgattcaaaccatggtaaaattataacttaaattttataagatagataaaaacaattcaattaatattccctggttagtttcagtcataatgattatataagttgggtattctcaattacatgagcatctctttaaggcagatgagaatttgatgatgttaatcatgatgatgattactagcatttattgaatgtctactatatgcaccactctaagcaccttgcatatactatctaatttaaactggctcatagatgacatactagtttagagtgtactatttgttgactgcattttaccctgtacttcaatttgatagacagtgtagatgtactaaattcattcttcattccctttacaaaaattgactgagttcttattgatgtgctgtcctggacagtgtgaaaaatcaaaggatgaatcaggcagagacctcttcgagcagatattattgagcagaagaggtaaattatgcacacaatagggtgcaagatgaaaagtggtatgagatgaatgatcataaagggtggtgggaattctgagatgatcatgaaaagtttcctgcccaagtggaatttgaatttgtccttgaaagagagtgaaatctggactgggaatgtcaaattaaaaataaaaatccagactttgtaaggtggggagactattgcaattgggaagctactctaactataagatctacaagcctttcaaagttaggcaaaaggatttttctttcatagggaagagtaaacaaggctggaaagaaaaaaaaaaaaagcagatgtagggaagtgggatgaaaaggagtggcaagatgtgacagtggaccccagaatatttaatcctaaagccagtatagtctctggaagggggctattaagagggattgtatgttgcctcaggctaaggtggtgcaaagctcagggatctagaggaaggacagaatgttaaccgtctttctttaagaagcattatattctgattgatcacttggggcaaaacagttcataattatctatgaggcaaagagtgggaattttgagtctttttgtatggccctgtcataggcaagccaggggaacaactgtgaagcagggtggttctgtgcagtaagccatttcccaaaacacaaaaggatgtggggatttattaaacttcactgttttccaagatcattggtcttgggtaaagttcaacattgtcttgggtatgggaggaaaactcagttaggacttcttaaagaaagagatattcatgggaaggtttcgtttagctgggatgttgacattatgaaggaacgcactaataaatggtgatggttaccctttttgaactgccagttccttttctaaagttaaaaactatcagttcatttaatcttcacagtcatctgatgatacagttacaattatcctccccattttacagacaaagaatctgaatccctcagagtttaagtcacttgatgatactcctagtaagaagtacaacagggactccaacttatgaagccactgtaagcctgacagagccattttagcctcttttcatgacttcagactttccctttataccaaagggaatggaataaaactgcttggacaagagcaagaagacatgcatccatttttcacattccaaaataatggactccaacacatacacataagagaagcagctggacatagaagaacttagaaaaacagaaagtccaagtttggatatggtgcacaagaaacaacagcagccaatggagcttgacaaagcagagtggcgataacaggaaaggttctgagggcagggaacaaaacaatggagctagtcaagacagaagggcccactgtttgtctgctttctgttttttttgagaatgaggatggggtggagattagggttaaatttaacactgttatctttgtaggcccaggtttctctggttcatatctctgtcaatgagactatcacaggtctgtgaagtttttgggggatttggaaaatgcctgctggattagcttttttaaaaaaaagtattattattattttgagacagggtctggttctgtcgcccaggctggagtgcagtggcatgattacggctcactgctacctccgcctcctgggctcaagcaatccgcccacctcagcatcccaagtagctgggactacagttgcacaccaccacaatcagctattttttttttgtagagacagggttttaccatgttgcccaggctaatctcgaactcctgggctcaagtgatccactcgcctcagcctcccaaagtactgggattataggcatgaaccaccgtgcctggcctggattagcttttaagagcaaccctgagctaccctgaagacatctcaactagtacagtttagccctccagagttgaggacagttgctgaatccaacacacattcaactctccttcccttttccctttgccagatacatttgcatttacttctataaatcacagctatcattgtttttcctaataattatcttatgattcaatacactcagtccagtgagcccaggaatacatagtacatggttctaaattttattgaaaatatttataactttgaaatgtaaataattgaactaaattcatcttctataaatcatattttgggaagaaaccctgattgctctaaccaacagagatgttattagaaatgtaatataataataaaagcaattaacctttactgaggccatcctgtgtccctgaactgatggtaggcactttcacatcctttttcatcctcccaggaacctattagtagaagatatggtttctattttacaaacgaaccaattacagttctgagaagttaatctctttgaccaagcagttgtactttaggccttgagccaagttttgaactcagacctctctgactttaaaagtcctctaagccattctacttggaatcaattactcacattttcaagactactcaagggcagctgtgctacctaatacgtgtaatgttgggaacaatatttaactacccgttgacttagtttcttcatctgaaatgtaaaggcaatcagaacttccttagaggattattgtgaagattaaataaattaatacatgtaaactattttaaaggtatacagagctactattttataagtgttagctatgacgattgatgattatgatgacaatgaaatcatactctctttctcaagtgaatagccgtactcaaaatgtcattatgattttgtatgctaaacaaaaactacagaaaattaggagtattagtttgctcttaattaaatttacatgtaagtttcttttaatcataaatttggaaatctcttttgtgcctcccattatacttcttagtctctaaaataaaatttgcattttatttgagaccacagaatggcagttttgataattggattttaaaaacctttttaaaaaaaaaaaaaaaagatttgcatattatttccctggtataaggaatctggatcaccaaaatattaagaacattttctattatttctcatttgtgtggaacatgggggtgttaacattgtcttgacttatttgccccgtatggttgttaggttccagggagcttcagctgagcttaagtgttcctgtctgaaatatctgagtcaaggtgtatgaaccagagatcaaacaaatcagtaaagaagtaacaggcataagactgaagtaaaaaaacaaagatggttccctatcactactaagtatggacagcccagaggtgtgacaaaccctattggttcttcttgcctactgcacagtaaagccaatacactgagacagcagtgttgcagtagaggatgagtttaattctcacaaagcagctgagctgaaggatagtatgcatttctcaaatcgacctccacaagaactcagaaactagggtttttaatgataatttgatggacagggagctagggagtaggtgctactgattggctgggaatcaaaccatagggatgttgaaactgtctttgtgcactgagtcagtttctggtttgaggtcatcacaggaccagtcaagtcagttccttggtatgggtcccaggttcaggtggcatcagtttgtctgccaggatgcaaaaatgtctgaaaattatatccaagaccagtcttgggaagcaactggagaagttataaatcttgtgacctctggccacttgactcctgagcagtaagtaattatagaaaacaagcttgggaccaagggtaggttattgtttaactatgcttgcatcttagcagaattcatgctcctcccataagtctaagcttgtggcctttcattagctttacaaaggtggtttcagtctgaacaaggaggggaagggactgttatcatccttgctttaaatttaaactgtaaactaaattcctcccgtagttatctgggcctacatccaggaatgagcaagggcagttagcttgtgagtttagaagcacaatggagtcacctatgttagatttatttcactgtaataatttcacaaaggcagtttcagtcacaagtatttaagagcagagacaaccacccaggaattcaaatctagattgaagtacaagctgttttaaagcctgcaaggttggtgtgtgtctggatgacaatggcagtgctcatttacctcaacaaaggctttcaacagccatagaagttggtgacaaatttatactctagtaagtatgtggtttacagataaggcaggctgagtttaaaggtttgcagtagggattgcaccggatagtgtgaaaattgtattgaaactgatattaaatatcttaaatataaagcattaaatgacattaatctagatgttccgctatgacttttatactgttatggctttcatctgttgctgccttgaagttgaggagaaaagagcaagcagtggcctctttgtgaggtccatgccgactggaactatcatcacacaaattactactaatatttgctttgttaaaaaaaaactttaggaacaaaaaaaaaatgagtaaaaactttctaagactatgtaaagactatactgacttttttgtattcctgaaacaagaagaactaagatacaaattattcaatcctagacctgaagaaattgtgtcccatggacaaagatgaaggcatttttctgctgccacctgcttcacaccattctctgccctctgaaaccagatgcttaaaagcaatcagtgactcactccacattacccaaaggataaattcccaaatccttagttggtttaccaaaccgtcaatcagtagcccccactcataccccttaccatcatctgtctccatttaccttattacactttaacttcccaaaattgaactttctttagtgtatattgaggaatattctctctgccaagaccactatccaaccacaccatatacattcacttgattaactccaatgtattctttgattctaatttataactccaaggcgaactcttcccttaaccctcaaattaagtgactccccctttgtcctttcataatgtcagggcacatttgtttcaaacacttttatagtgatacctttaaagaaatgtttccaaaacttcagtacacacaggaattatctggagatcttgttaaaatgcagattctgattcagagtgatgccagtgctgctccctgtccccatactacagagtaagtagcagtctgtctgttccactagacctgagagtaggatcctcaaagccccacttatattaggccccgaattaacagctactggaggaatttaagaaaacaatacacaattggcaacacaatttagttttggaatacaagtggtacttacaaatagccatttgagaaaaaccttgttaacttccttccctccttctgtagcttggtatttccaccttttctttccttctctttgcctcagtcttcactcctaaatggaagtggtctctcagttccctccttaatcacggattcttttcatgcccagtagtcaacccttgagatattttcagtggtagcacttcagaaaatgaaaagcaaagggagccaggatagagacatgaagaaaaataaactcctattctcttcctcagtaatcagtgagttactttttctttctccagatctcacctctctggccccatcagactatttattaaagaatcacaagtacatctctagactcctcttcagtgttgcattgctcagaaattcgttgtgtaggtggtgctcagaaatagaaatgaacctcatatcagtcattcatttacataaagacttgtcatatatataattatagtgtatatatatgtgtgtgtgtgtggtgtgtgtgtgtgtgtgtgtgtgtgtgtgtgtatttttttttttaaatagtgatgtggtcttgctctgttgcccaggctgctctgctcttggacttctggcctcaagcagtcctccctcctcagcctcccaaagtgctgggattatagacatgagccactgcatacagtcaagaattgtcttttaacatctaagtagagacttaatcttgttttatgtctctctctgtctgtctctctctctctcccccaacgtgtagtcattttattccaaaggtttgtagttgcatggactataaaaatggaaaaataaaaataacacaaacttcctggggtccccttactacccatatccccataccttgtctcacctacgacaggtaaacagaatcttggagagcaagtgctgtggagtagtcactgcatccaaggtagagagtggtaaaaatgtttcatcgaaaaataatttttctatgaaatggacaggcctcttctccattaggtttaactgtgtttctgactgtgtataggagaaaatgggtcctcagatttccaccacagggtggttctactattagtacatacaaatctttgttaggctttctgtttctttattgttcaaaggcacaatataaggaatagggctagtctgtatttcagtgtaaaatatatgacactttatatatgtgtatatatatatatgtgtgtgtgtgtgtgtgtgtgtatgtgtatgttatgtatataaggttgatttggtctgtatctacataaattacatgatagatatataaatgtgtgtgtgtatatatgtaaataagtctaatgtatacttataatctatatatttgtatttcgtgtgtgtatatgtatatataaacctatattttcatttcttgtaataaaataattaaaataattaacatgaaaaagagatcagaagagaaactcttggtaaatgtataggtttgtctattaataagatgttagatgtgctatagatgtcatagtaaagataacatcccccaaataccaaggagaatagaatgattatactagggtgcgaattctagcaaattaaaataaatatctgcgtgatccatgtttgtaactatctgacagactgtttgctgttaataacttttctggaagccacaaacacagcagtagcactcaattatgatgcggtctacaatataacacaatgcagtttttctgctgccttcaagattacataggcagcagagcctaccataatgaactgtcccgaaaactcaaagtgctgtttgcagcaattttgcatgtgagtattcagattttacagtgtatgaagtctgacttgaatgtgctctacctcagtaattctcatttcaaaatattcacattaaaaacattcacatcttccttttttgattgaagaccatgctaataaaaaagcacatagaatattgcaaataaatagtcatagtgagctaagaactacatggaacactgagattcttcaaggtatgctaatgactttttgtttagtagatttcttgtgctgcagtacgcatgttaataagtatttcatcctcacacaaggtgcttggtgatgaacacactagcccagaattatcagcatacatttattcgattatccgcttgtaatcaagaaaatatattattccttttctcttgatattttggttcatattatctaagtatatgtctaaagcgttaataatattataattcacaaatgtaatgcttaaataggagaaaatattttaaagattctcaaaacctctgtaattttttttcccattaccaacatcattccctttttgctactacatttatcctaattagaaaaagtagcagagggtttgaaagaagaaaaaagaaaaggaaaagtgaagtcttcctaataagaaatattatgttaagtactaccacagcaaattatcattagtgggaattagaaggagcccccttaaatgtgtatataatgctatttttaaaggcttaaaatattttatttcaagttttaacagtatcctatgttactctttaaacattttagaaacttttacaactcagtttgtttcatattaaataagaacttagctgatctcttttggactcactgtggaacattgcattaattgttagccataggacaacaataaaaaaataattttagtaaaccacataacttaggtgactcatgaatgaaagcggtttacagatgtgcttattgaccagaaagccttaatgttcccctcagcttgactaactttagatagatcctttcatgattattggcctccgacctccctttgcttagagcattcactttagaaaatatggaatggtcaattctttctctgcccctttaaggtgtaaatcttctttcagtctcttgccagttttacaccccagaaatgtctttcccaaagatctgggagctagccctttgaaatgtaatcatcaagcaagatagtacccctacctctcaggctctttgggacagtaggagcctaactttgatagataagtgacaatctgcacatatggcctcatctctttgagcaactctccctacacaaagtcctctagtacttttccactagctcaccccaatacttaaaaattatcccaccttttgtactagtggaattgagttctgtctgtgtcacctattgcaagtctttaataaaatctttcttgcctgtttaactctgccttgtgcaatttttctatgacattatttagactccaagtttactgtgcagagtaaaggaatagataagtggagagattttttaaaagggtttaaatgaatgttctaagatatagcaatgactcatttacctgccatcacttgccttacccttttaaaccataatacttctccttctacttttatcattcatgatggaaatattcctaaaatgtagtagcaagccttctgtttctttctcaaaatgaagatttgtttctcaaattgaaagtagttttttgtgtgtgtttaaacaaaaatgtacatgtggaaaataagacactgcaaatcacagattaaagcagtgtttctcaaccttttaaaaatcattactgccccgctaaggagcttttttagttattttttcctgcctcatctccccatgagattttaataccatgaatacatggtatgtctgtttatgtactgctgccttttggggtgccataaacccttacagtatctaagatttgtttgctcccacccaagaaccagtttttgcaccattaggataatattgcctctttgaaaatgcatggtttaaagcacaaagtaaaaatcacttaaaatcccgtaccacagaggtgaccactgtttgcctttagacaaacatccttccagagatctttctaaccatattttatgtgcttttaaaatttgtttttgtgctttaataacaatatggaaatgtttccatattaatatagacatcatccctttcaagtatatataatttatttaaccaatttcctgtgacatacattcttccttcgatttttatattttaagtaatactttgatgaatatcatgtcgtatcacatttgtgcatttgatgtgctgtctttagaaataatttttcaaaatgcaatttctggatagagaggcacatacatttaatttgtttttataaaaatttccaaactatcttcccaaaagattttaccaatatacattctttcatatactgcatgagaatgcctgtttacaacatagggtattatcaatttgtttaatctttgccaaacttatagacacaaagtaagtcttcactattgttttaattctttattcttttatccttaatttgataactaattcattgagtttttaagtaagcatattggctatttgcatatttaaagatttccctcatcttgtaactttttgtcatttttttttactttttttctttgtagtccttattaattacattgcctaaaagataataatcatgtacagtaatgaatgcattttacagttgtgcctttgggaactgtatagggctctgtgcctattcatttcacaaattatttttgctttcttctgaactgacttcatataaaaataaagatgatgataactatggatacattaatgcatgtaagctttatagaaaatatttgtatataaaatagatattttatattaattttatgtgtaggtatttttttaaaaaattaaataatttccagtttttatttatcataaataattctcttttatttaaaaagagctctaacattctaatgtattcttttcatactgaaatttataaaccttctcagttcccttctcaatcacttctgctctatagactttgaactgacatatttatttgatttctttcatctttatctcttttgtaaaatgtcattaggctgagaaaaatataatgagtccatgaagagatattttttaaaaaaacagattttatggaaaggtaaaaatcaaggagaaaactcaggagagtgtgaacacatcagattaatatgatcattgctctcgttccagttaggctcattccaaatattttaacgtgctggtcatgtgaagtaatacttcttttcatagttgtcacactgttttttgccatctaatctgctgtccacttctccaaagttatttatgagatttgttattgatacatcttaatactttgcaaatgccaacattttcctaatattttgagtggaataatatatatttgtaaaacaaatgaaggccaataattatgctttagatttggggactttttgttgagaatcatcgatatagtttgatagtatttcattataccttacagagtatacttaaaaatactcatcaattattgttttaatttatagtttaggttcacaaaagcattatttaatccaaatagatttcacataatataaaatacactattttagccattttaaagtgtacaattcagtggattttagtatattcacagtgttgtgcaaccattaccactgtctaattctagaacatttccattactccaaaaataaaccccacacctttgaattctgcctcttctacctcctgccctatttcctggcaatttctgtctgtggatttgcctattctgaatatttcatgtaaacagaattatacaataggtgatcttttgttactagcttatgcaatagcgtatttttaaggttcatacgtactgtagcatttatcagcgctctattccttttcatggttaaataatattccattgtaaggatgtaccacattttgtttagacattcatcacattgatgaacatttctgttatttccactttttggctattatgaataatgctcccatgaacatttgtgtacaagttgataatgtgaacatgttttaaatttacttgggtatatacataggtgtgaaattgctaaatcataaggtaactgtttaacttcctgaggaactgccaaattgtttcccccaacagttggacattttatattcaaatactacaatccgtatgtttgtagtgtttgaagtttccaatttctccacattcttatcagcacttcctgttttctgggttttttgtttgttttattattgttgtagccatcctagtgaatgcgaagtggtacctcattgtggttttgtgccgttgtttttaaactgcttgatttatgaatgcatttgtggttttattaatagaattgctaaggtcaaaattatttaaaccattttcaaacatggtatgtgtcttgtgacatactacaaaaagttggcaatggttctctattacatttacgaaagaaaaaacctgctgatgaagttgaggctctgactgtatgtattaaactttaacctaagtcactattgacagcagagtatttcaacctctgaagacccagcctcactaaatttgcaaaaatagttttttaaaaattgtactaatacatttctatgttaatggaatggtcactttttcttttcaagtctagtatctaaagtactctgaaatggggaaaagatcatgcttttatagaaattttcttgacctgagcttccattaggggaaaaaacataacttccgattgaaaaatatatttacataataccaatatataaaccattctttcagggtaagccaaacacatctaaaaattccattaagtccattggactggcagttattatgttaaatatattttcatgaaacattttgcttccctggaagcaaggcaacaaaaaagataaaactaattaaaatgatatggggaagaaggagaaggaaagtcacagtcatagtatgttttagatttttcttactgatgaataaaaataactcctttgatttggattatattatagtaattttcatcacttttcaaaaatcttgttcaaaattgtttagttttagtaacaaaatgagcctctttctaccattttcttaggaattctgctactgggacattttgcaaaagctgcaaatgcagctttgattttactaagtaccgtgattttgcctgcattttcaagtacctagatagaagttagggcttaaattgtatttgctaaagttttgaggacttctgagaaaaaaatacaaaagaatataaacatcttataataattcccatactcccccgccctttttttttgttcccacttgtgtaggagacataacccaggaggtgatggagaggagcaaaaacctttccttttctttaatcacttgagaaagagagtcaatctaggaatagctaaaattactgggttctgagtgatgaagacttaagctatttgagaatgaaataaaaattttatgaagtgactgaaggcaaagtcaaaaataaagagttcacaaaggagaatatacagagtactctaataggtcctaaaggagattttagaaaagatattactttatcatactgtgttatttaaaattgccttcatgtttgtctatttttataaagtacatgtgtgtgtgttacaattttttggagatttttgctctcaattctttatatcttacgtgacagcaattagtaccatgtaatttgggcagaaattcctccaagcgacaagcagaatatttcacagtgacattttaatacatgtataaatatattaaaatttgtctctacaaatgcaaaattttaaagtaagatcaaataagaaaattatttaatttttattacttcctacataaacagagaatattttatttgtgggactttttataaatgctgagatgcctctccacctccaaatcagagtgttttaaattttataattctattatagattcaatcatttgggtaagtttacaatacatagctgttaataattattactgagactgaggtacatacaaatagtggaaagctaagatagtccaatatatgtgagcctctgttagcacaggacagtcattttatctgcagataaggacagttttatttcttcctttcctagctacgtatattttatttcgttttcttgccttattacacagactagatctttcagtactatgttgaataagagtagtgagaacagacatttttttgtcttattcctgattttagggggaaaacattcagacaatttgctctttcaccattaaatagcatcttagctgtaggttttttatagatgctcattatcacattgaagatgtgtcccctaatccctttatatttattcttctaagaattcttatcatgaatgggtgttacattttatcaaattcttttctgtattaattgataataatcatgtgatttttctttagtctgttaatatggtggattacactaattttcaattattgaaccagccttccatcctaagaataaactccactttgctctggtgtatacttctttcatatatcactcaatatgacttgttaatcttttgttaaagatttttgtgtttctgtcaatgaggggtgtttgacgtcagattaatactagcttcataaaattaattggaaggcattccatcttctcttttggagagaagaggtagtataagattgatgctaattcttctttaaatgtttcatagaattttccagcaaaatcatctggacatggagatttctttttttggagtagtgttttaattatgaattcagttttcttgatggttatagggctattcaaataattaaattcatattgagtgagttgtcacagttcatgattttggagaatagatccattttatctaagttgccaaattacaaagtgtagaattgttcacgttagtccgttattgtgcttttggtgtctacagggtctatagcaatagtgcctgtttcattcttcgtattggtaacttgtgtcttttctctttttgtctttgtcagttttgctagaggtttatcagtgttattgatcttttcaaagaaccagttcattgcttcgttaactttctctattgcttttctattttgaatttcattgatttctgctcttgtctttgttgtttcctctgtgcagtgtgctttgggttcatcgtgctttttcttttttcaggtttttgaggtgggagattagaatagtgactagagatttttcttcttctctaagtaagcatttagtactgtaaaattttctcttagcactgctttggctacatcccataaatgttgatatactgtgttttcattttcattcatttcaatgcattttttacattccttgaaacattttttggcttatagattatttactagtcgtttggtgtccaaatgtttggagattttcctgttatcttttttgttactgatttgtagctttactccattgtggccaaagaaaacactttgtatgatttcaattattttaaatcaattgtggtttgttttatcccctatctaggtatatgatccatgggaacttaaaaagaatgggttttctgatgtctttgagtggatttttctataaataatgaccagatgctgttgatttatgatgttgtacccagtcagtagatttggatctctagatcctgaagaatcttgccatgtacacagttggtgcttatgaagggtttgttaaactgtttggacctgccatagtattaccctttttcctgttaccacatatacctctcctgtggtctgttaaaatttccagaagaaaggcaagcagcttaggcagactacagtgatagtgtggcatcactaacaacccaaagttaaaaagtttgcaatagcagtcatttatttcatggtcaagggtctggagtttggcttggttttaattgatcttgtctgtgcttacctgtgctctactggactatcctggattctaggttttgggttagattcaaatctgttccatatatctaaattttaggattcatactgaaggagcaatagctgtctagatcatgttcttttcatgggaaaggatgtaagcctcaggagagctggcagaaacttggaatatctcttaaaggcacaatgtcacttctacctgtattccattgtccaaagccagtcacagtaaagtccaaagctaatgcgttaaaggtatatactctgcctattccagtaggaaacacttcaaaattgcgtggcaaaaggcatggatgtataagtctattacaatgagggagtgaagaactggaagctattattcaattttcctttgactttcaatctttaggactttctactctacacagggatcaggaaaatgaaaattaactctccacaggaaaactaatgctccacatgaaaatccctatttggattgaaaactataaagaatgtttcccttgacatatagttaagtcttatatattatattttggataatttgaagaaatggttttagtaaattaatgagaaaatgcttcagaatatactttatagtacatcaaaggcaatgtattttcaaatccaggctgtattatttgtttgtttggttttttttttttttttttttggttttgaactatatgtaggcattttgttgacaggactttttgagaatccattgcaagcctgcacagctacgttaaatatatgaatataaaataggactcaaccttatcaatttgacacgtgtgtgtgtgtgtgtgtgtgtgtgtgtgtgtgtgaatgtggtaaaacatctgcatttgtcatcaatttttggaaatattcgaaagacttttgtgaatcaaaaacctataaattatttggtatttcagatagagatcatggaatcctattaaatgatatatgtccagggttttgcaggtcacaacttgaattttattcgaagagatataatagtcattaaaaaataagagaaaaaaagaaccctggggacagaaattttaatttaaattcagggcaggcatgtagtacctgatattccatgtattcacagaatgacagaaaaccatccttacctgcatggaatgatggcagtgattgtttagtgtccattcaaaacagtaactggttgcagttgaagtagtacttttaatcatatggacacttgttccccaagaattgacctggagccaccaaaacataaacacagactattgagcacagaaggagccagtaattactttcaatcactccttgtcaaaatggtttgaattcaaaccaatcattcataagagaggagctacctcattaatagttttcttagttcaagatcaagaaaaatgataagccatattaaaaattgtttgtgtttgcaagcattcaggagaatgacatttgaaacacaattaccaaaacaaaataaaagcagctaacttataattcaattagagcctttccaatatttgtcaaataaaaaagagcaaatttcagtgaagaaaatcaatgaaggaaaccatttagaacatgcttattgctgtttgacttttgtcagttgcaagaaagggaaatagttgaaatattggcagtaaataaattttacagttattacttgtttcttctaattttctctcccttattgacttctcatttctggtaatatggcaataaacaatatgtaaagagctcagcactggatgtgattaatgtatgcagtatctgcagttaaaacattcttctctactgatgtctgtgtcatgatcctccttttttctcattttccttcaatgttgatttgcctcctcttaccttttttcttctgttattatctactttttacaactttaacaatgaccctgcatatccttcactggcctctctttcaaagaacccatcctacaaatatgcccagctacctactagacatgttcactggaatatgtccatgttaccctaacatctcccctcctttatgttgtgtcctgtctcctatccccttccctctaagtaaccaaaatcaactcattgcttttgattttctaattagttaattctggcacttaagtcaaaatcaccattgtctttgatttttgcctgcagacacttccttgttgaatatgtttgtgcaaacttctatcagataaatgtacctgaaacacacttctcattgtgtcattttactgttccacatgaatgtaaccattgttgatgtatactgggatgtggaaatgtttgggaagcactgatgaatgaattaacatgattacttcttcacaactatgtccctgtactcactggtgctagtctgctagtcttgaagatctggtgggaagaatagctctttcctatactgcacacttcttttcctgttgcggtggatattttctcaaaactttatcctcaggcaaatgattccacgtgcttacttatatccgtaaaatcctcaaatttcatagttagctgatggcaccttattattttattttggtgtgagaatggaaagactcattctcttatacagtttctgccatttcagtatgatttcatttgggaaataaagtaagataaatgttcttatttcagcattttatatatttttaacatctttattttgaaataattttcaacttagaagagttcacaaaataatacatagagttcctgtgtaccctttgtataacttctccaaattttaacttacataatcatagtacaattattgaaataagaaaatgaacattgattttatactattaactaatttacagattagttctggtttgtacagtgtaatgttcaactattagtatattcactacatttatccaaagttttgtttttagagcctgcatagccaaagcaaggctaagcaaaaagaacaaatctggaggcatcacactgcctgatttcaaactatactataatgccatagtcaccaaaacagcatggtgctggtacaaaaataggtacatagaccaatggaacagaatagagaacccagaagtaaacccaaatacttacagccaactgatcttcaacaaagcaaacaaaaacataaagtggggaaaggactcccttttcaacaaatggtgctgggataattgggggaaagagtgggaggggggtgagggatagaaggctacaaatatggtgcagtgtatactgctcaggtgatgggtgcaccaaaatctcacaaatcaccactaaagaatttactcctgtaaccaaatgccacctgtaccccaataacttatggaaaaataaaatgaaaacaaaacaaaaacacacaaagttttgcttttacttaatttaaaacaaagaaattttgtaggctgcatgtggtggctcatgcttgtaatcccagcactttgagaggcttaggcaggaagattgcttaaacccaggagtttgaaaccagcttgtgcgatacagggagactcttgtctctgtagaaaatttaaaaaactagctgggtgtgctggtccatgtctgtggtcccagcttctcaggaggctgaggtaggagggtcacttgggcacaggaggtcaaggctgcagtgagccatgatcacaccactgcagtccaacctgggcatcacggcaagaccctaactatctcaaaaaaaaagaaaaaagaaggaaaagaaattttgcacttgaaaatagttactgatctttagatggataagtaaaataataaaatacctaaaatattttttcattttattctcattttcaaaaattttatcttttacttatctaattattattcatcctagttgactattttcattgtacagagcaatccccaccattatacgatgaaaccttagcaagtttttgttctttgcaacctaaagactaagaatccttagtagaatcatatatatggaaactcttgcacaggaaccaaatgtgtaatgtgtctcattcagagtggaagtgggaccaagaaatttattaggaactgaagtgtgtgctctcgcttgctctctctctctctctctctctctctctgtctcaatcttagtgctcacaaattatttaatattaacctactgaatactgaatatgttaataatttattcagtactcagtagttttttcttcttgtctctatataactcttttacaaaacttttttctccccttacaaatggcaacattatgaccatcataatcaaagtaagtcatcttccagctctattattcgccatagcctagaaacttccctttgtgactctgttcataatgcaaaagaggaatttctgaacatcactggttttgggagggcagaccactgatgtgtcactggcttgtatatcgatgcctttcatcccttatgtcaggttcttacctctgactaaaccaaactagctatatcatttagtctttgctacattgcaaccatctaccccaaatatagtaacttatataataatcattcatttgcttacagtatggtggggtcgtcaatttgggctggactcagaatggcttatctctgctctacatgaggtcaacttatgtgtctgcaagttcaagtatcatggctgagcttctctttttatgtgttctcttatcctcaaggagcttagtctaggctcattcttatgttgatgaaaggggtcccagaaacagcaagagagagcaatccacaatacagaagtaccttttatgtctctccttgtgttacttttgccgatgtcccattgaccaaagcaagttacatgggcaagctcagattcaaggtatagagaaatagattttaccttatgttagaagaagttgcaacaacacattgaaaagagacatgtggctgggcgccgtggctcacgcctgtaatcccagcactttgggaggccaaggcgggcggatcacttgagatcaggagttcaagaccaccctggccaatatggtgaaactccatctctactaaaaatacaaaaattagccggatatggtggtgcacacctgtagtcccagctacttgggagtcagaggtgagagaatcgctttaacccaggacgcagaggttgcagtaagcctagatcatgccattgcactctagcctgggcgacagagtaagactctgtctaaaaaaaaaaaaaaaaagaaaagaaagaaaagaaaagagatatgcatacagaaatggaagaatttgtggccttttgaaaaatctgtcattctaggccaggtatggtggctgtaatcccagcactttgggagggtaaagcgggagaatcacttgagccctggaatcagaccatcctggacaacagaaaacagaaaaaacctatcacactaatatagggaacctgggtgttacaacgtagaacataactatttaggacaaaaggggatgtggacaagcatttccccagccagacttgtgaattagtagctccagaatgtggctgatacaatgagatcagcagggtgttatacttcatttatattgatgcagtttattttattaataattataatgatctcaacgagagtcacgaaacaggttgaggaaagtatataaataaaaggcacacctaccatccacagtcagtcctttgattgtagtctaattaagactagataatgattgaatatcattgtccctgatggtggttttgtagtacagacaaattaaaaaggtggtatacttcctgatgtgaaagaacccactttgggagaaaagacaaaaacatcatcaccatgaacattaattggggtcagtgttggaaaaatgggaatttattctagctttcctttcttcacgttagccctgtgggctgaagttgtacattttttaatttctcttgaaaattgcacagttactgcccactttgtgcttttagattgggtaaacagaagcagtaaattcccagtagctaatgctttgctgtgtaaaggtggaaaatccgtttaaaagtagtcatataaacctctattttctggaatgtttctaagatattagaattggacacatccataaaacagatttctctatgaggtcagcaggatgccatacttctttccatgcactaaaaggcacaccttggttctgaaaggcttaatagtctcaaaaagtgaacactccagtcttcactctgtatagattcactcccagggagagaagggattctactagtgagcagaaaatcaattgctgagtttctgtagctgctttaacttttacttaccagtaggacgccattttctctttgggaaccccactggcctaaacattagctcccttttcaccagcagggtcaggcccttgctgtttctgagttaggagttttatacaatatacagaaatgtccttatttttaaacatataattgcatataaaaatgtgttggtattccttagagatagttgttacaagagaaaacctacaaggaagtaaactgtaattgaccactgcctgacccgttatatggctgtatttaagttttatcctccataaaataattatgatggctttgtgtgttaaaaatagctatttatattcatttgagtgcaatacttgttattctctgccctggttcagtcataggagccctgaaaagcttatggcctgaaggttttgagttctgagttgaacaggataaacactcctttgacttaaaggggaagatgacctttaccattgtagaattcctgtaacaaagttgctgttcattaagtatcatttatgaattccaaaatcaatttgaaaaccacatgatatatttttaataattctagtacacgacatactgtagaaaactgctcaaattgagagaaaattaaactagaaataactaccagttgactgagtacaacttttagttgaaaacagtacagttgtccaagatgtatgatacagtaccaaacggttctcaagactttttgtcctatatattttttttaattagaaaactcactttgaaatttttgacctgtcaaagtgaaagcatatcttgaaaaacaataaagagcaagctggttaaacattgaaaaactgtgaaatgttgaaagcctccccggtgagtaggaacctcattttattacatctgcgacaaaaaacaaatgaaaccaaagatctttgacagtcatttttttataatttatttttagtaagtcatgctgtatattgcgtcttttaaattagggtgtatcagacaatacttagactgttctgtttagaaacttagaaaaccattttttaagggggaaaaagaccaatatgtgctacattaaataatcatctaaaaataaaaagcaattttggttctgctatttcctaaggcttaattaaaccatatatggccaatacagtctagtgactaaggaacaacacataccatgatgtcaggtagcagttttctttctgtgagatgctacttggagggaatatgtttttaggactaacaaagcacctgacaatttattgcaatgaacatattaataatcatttagcaacatacaagtggttacatatagtatgctcttggagaaaccagttatactttgtgtagccgtttcctcaagaaataatgcccagtataatttagaatggccttagaacatttaaaccagtggtgtgctgaagacaacttgtatcagctcgcaagagactggtaaatggtacaaatcactgacctacctccctctcagaaaaaaaagtgattaaatattcatcagtgtattactgaatttttaattatatatagtttaaaaacgattggattctacatgatcttattttgaatgaatatccatctttttattcttactgtggactctcagtgtaagttcctgaaatcaactaaatacatttataaaaataatttatcttaaaaaacatgatccatctatccttgtgcatatttgctattatgtcaaattgtacctcctagttagagtgcccattagtatacatgcatttttattatgccagtgtatgtggaaacccttttgctccccccaaaagacatgctttatcttgcctttgaaaatagaatttccagttgattagtttttattgcaaagctgcctttcacactttcacattgaggtaattatatgcgcctcatattgttttttaaaaaagatgtttcattcattgctttccaaaaaaaaaaaagcaaaataatttatttcctctgaagagggacatgaatttcagtgtttattcatgaagtttacaattgatatatgtattataattgtcctagaaacactttttacaataagatatctttgtaattacgcacctaggataatttggtataaaaagcagtgatattaaagagtgaatagtgtttgcaggtcatagagctttgctctagtattatttgctttactgcaggattcaacataaggcaggtgtcttgtctcatgaagtttattatagaaagagtccttataccatattttcacttatgatgtcgaaacttagaataattttattcaaagaatatcctttgagctccaataacacaaatcaggttataggaagtatcaccctggtacagaattgttcacatactcatttgtcattatttgaagaataaatgaatgaatactaagagcaaaaattagtggcataaatcagaaatccattcattaataaaggagaatacctagcatgtacttgaacagttagggtagacttcattgctttggtaagactttcatgaacatggagtttataagtggaaagacaagaaatgtttttggtagaagaaattgcataagcaagcatgctgaggtataacttcaagtacatttaaagttcagtaaggggccaggatggttgaagccaagattccctgaagttaattctggagagttggaataacattacgtcataggagagactgaaagttaatcctgttggtcatggggaaccactgagattttaccaaaacacttgatttagaaagattcttatattgtgtcaggagtgaaattagagtgggaaaaggaagcgaaagcctggactggttgacttagttccatgagattctctgctatttaaatgtgtcctcagtctccctgctgaaatctaaagaataatctgaaggcaaaattattcccaagtacgaaaatgttttagaccttcttcctaggcaaacatatttctcaattccatgtccatattacagagattgagtatagtagagactcagttttatcacttgtcaacattaatctgttgattgaaatagtaaaaatgtgaagaatttgattcaaaataattttaaacatatacatatactaatatttactaagactctttgacatgcataatacagaatcagagtcatgaaagtaaatgcgtaaaagaaagaaaatacgcaatgggtggttgaggaatacaaagacttttaatagaagtttcaggtatttcagttctcagagggaaatgggaatagctagcatttatccagcagtcctatatagtagtatagaacttgtcatttacagatgtcctagctagggctgctccacaacaataccatagactgggtgacataagcaatagggatttatttctcacagttctggaagctggaaagtccaagatcaaggtgctgatagatttggttccttgtgagggctggcttcctggcttgtagatagactccttctctcttcattctcacatggcggagaaggaggactctggtatcttttcttcttataatggcaccaatcccaccatgaagtcctgcccgcccttatgacatcatgtaaatctaattatctcccaaaggccccacctccaaataccatcacattgggggttagtgcttcaatatatgaattttgagggaacatattcagtccataacaacaggtgttaccatatttaatatttacaacgatccaatgaaaggtactattcttcccatttatacataaggaaaccgcgatagagatagctttaaaactttcccaagattagtggctgcagggtgagggtgttgagaagcagccagggtttgaagccaaacagattcctaggaaaaatattcttaactcattctctgagtttaagtagggtattagcagtttaatgatgatggggtaacagttatatgtaagtatgagtgtgtgaatgtgtttatctgtctatctgagtgaatgagagagtgaagaggcagggagagagagcataagcaataataacagaaggtaggatagtaatttaccactcttactatgaggtgtgggtgtactgttctagatgtgtaactaaaaggaataattttaacctgattattttcatcatacccacttggtggtcattttgtaaactcccacagctcttgtaacagtatatctcaatagtaaaaaagtctttgaaatctatattgggcacgctgagtaaagtgcatcttttttcttccaggaatctctttctaacagtggagaaaccaactggtgaagatcaataaagaatgcttgttttaaacaagagtaacttatgcatacatatgcatacacacacacacacacacacacacacacacacacacacacacagagagagagagagagagaatataaggaagaataaaatcatcttattttacaaaacaccagctgtgttccagtgttctatctattgaaaatgagaaagtatttgactaaaataaaaaaagaggaaggaaataatttaaaaatggaccaaaaaaaaaaacagtcaggagaagaaagctatattgaggaaatcctcttgacagctaatattatttttagcattactaatttgacttccttgataatatcagcacttttactattacaatcttaatgacttgggaaatgcaagctggatagaaaatgtcaaactggaaaggaaaatttcaaatgttttgctttgtaattaaggcctgacaaatataagtcaattttagcataatagatagattatcaagtagggacatttagctaatgttagaggtaaaaaaaattataatttatatttgaatacattctgagatggcttcagtgtgctgacatgttttaaaaagtgtaacaagtcttaacaagattccaggaggggatacacacatgtggacacacacatacattcccaactatctgtaaagggccagagagttcatattttaggattttatgggccacacactcttgatcacaactacttatctctgctgttgtagcatgaaagcagtcttagacaatatataatcaaatgagcatggctgtgttccaataaaattttctttacaaaaccaagcaaagagccagattttgcccccaagccatagtttgataagcacttatctaatacatattcatatgtttcatatagagggatagcttttactagcaagcagtagtaataggtgtgtgcatcattttaagcccttaaagagctaaatcatatccaatcattcaacctttaaaaaaatttgaaaattcatatattttatattttatctgatgcaaccgttcctattaatatttaattcaaatgaaagttgttaaaatgaagtggcattttcatattcaaatctactttaaatgtattcatgcttgtcagtgcctcaaatagaatctgtgaaaaattctcataaaatagatcctaaattttgtcaaataaacttggaaaataattgcagaatacttatttaccacttcccatacatgatttagcttaactaaggtgccgatatctgtgtatgatagcaagttaggtagtaggggggttggcatttatcttaaggagccacagtgacactaataattgatcagaaatagtcaagttcaaaggaagcacgttcaaaaaagatagtgaagtttctttaggtacaagacggaaaatggttgactctctctatacctaatattaaaaaaaaaaaagaatctatggtaattttcttttcttctattcttttttattatttttatttttttattttttattttattttttttttgagaaggagtcttactctgttgcccagactggagtgcagagtgcagtggtgcgatcttggctcactgcaacctccacttcccaggttcaagcgattcttctgattcagccacacaagtagctgggactacaggcgcctgccaccatgcctggctaatttttttatttttaatagagacggggtttcgccatgttggacaggctggtctcgaacttctggcctcaagagatctgcgtgacttggcctcccaaagtgctgggattacaggcatgagccatcacaccaggcctacagtaaatttttaaaaagcattttaattggtaattttacagtaacctgggatgcagaattgaattgttttatgaattaatctccaaggagttacttgaatttgttctctctctctgtctctctctctgtgtgtatatatgtacacatacatgtatatgcatatatatatgtatattctatgtagctctatatgttttgttccattagacaacctggaatacataaatgttaaaaaattttttgtgaaacagtggcccacattaaaaacggttctcatttttgtttgtcattcctcagaacaaaacagtatttggtggttcaacaaaatagaaaattaattttaaaaatagagaggaaaataaatttaaatatgatttttcccagtagtcctataatttatcttaataagaaaggagtacaggtttcaatgcagcattgttctaagactttttgtgcatatcagaatttggattcatgtttttttaaaaaggaaaagaaacacttgtcgtggaaaaagttattcagttagtcaaagtcaaaataacaaaataagaaacgtcaagtaagtaaatataacctgggagttctgaaataaagataacaaaatgattttatcaagtatctaaagtctatcatttctaaagtgggtaaagctatcataaataaagcagaattatatttacttttctaaatactaaattatatgcagtatatgcatacaatttgctttatttaagaagatggctaacttatctgattctttctttatatgttttagattaattttctagagttgactctcactcaggtctaggcagaaaattattggtgtggaaaatatgcccattccagtgaggtcatctattacatgtgcatgtaatatatggcagcaggtaattgagacaatgtctctttgagatggcagtccccttgaagtcattgccagggaatatatttctctttaattttttatgagacaatttagggaggggattttgtgacttatcagttccagaaattatacctagcaatacagaaaatgatatgttttttcttgtggatggtacagctttgttaatttttgattttgagatgctttagggtagagaccaggcttatcagctcaatgagaacatgtgtttttgtatgtttcattcttggccatatcacaagtgcctataacagtgcctggacaagagtacatgctcaataaatacttttgaatcacaggattaacctttacattgccgattgccagcagaaacttaggagaaagccatggtggataatcaaaaagtacgattaaattaagtggaaagagcaattataaataaataactaccttaccattccccacagtgggtctgggaattcatccttgtaaaaccacggagagtgttcctctgagagtgactacagattttttttttttttttttttttttttgagacggagtcttgctctttcacccatgctggagtacactggcgcaatctcggctcactgcaacctctgcctcctgggttcaagcaattctcctgcctcaacctctcaagtagctgggattacaggcgcccgccaccatgcctggctaatttttgtatttttagtagagacagggtttcaccatgttggccagagctggtctcgaactcctgacctcaagtgatccgccacctcggcctcccaaagtgcagattttgtttctcacataatgagaagctgagtgcaatctatatgctgtaagaatatcccattcctactcaatagtgtctttatgactattactttaaagaaatgaagtaaaaggtagttttacttcacatacaatatgtgaagtaaaatgtagttttggtttacatgtatatatgactatatgataatacttcaggaagtcattaatgaggaaaacgattccaagacacatacataatcggattttttagctattgtgtttgtagcttactttcaacattagtaagcagttgtaagagaacagccattaccaattactgtaaccgcagcattacacagggagaaatatgactgttgaccttgaaatgagtataagatcatccccagtagaagatcacagtccaacaactctcaactctggctgcacattgacatcatctgggggagcttttagaaaattttttttattagatctaggccctaccttcggagactcttcactgtttggacgtctgtacatttttaaagcaacccaagtgattctattgtgcaattatggttgagacgatcgaatgctcttcaaattgttttactcagataaatttaaaggaattttgaaaaaacgtgcactatctcccatatttcaactataaaacatttcagcatatgtttaaacagtttcaaagaatatacattcctctgcatcatctatgtgttctaaatatattttggttgaatctttgaattgggtatttaactcattttgtttgtgggaaaagataacattaagacagaggcttgccctgaatttttttccttagacaaaataaagatctgtacctttcaatattttctttaagatatcttcaatggactatcccaaatgctcagcgcattatttaatggtccttttgtttgatgccctggagggttttactccctggagcaatatgctttgataagatttgccatagtgaggtacgtctttcttcttcaaagtaagaaaagtgtggttagataagagaataggcacattatcagatcaattttagatgtgtctgaaagctgaagatctggaaatagattcccttaaatatgttcatgtctgtgtactccttgaaaagtcctcatattttagtgtatgtacctcagttggaaggtagctggattaaacttggagctggtagttttggggaagacagagacaaggggacaggcatgagaattggccaatccctggtgggatctccaaactgaccagcaggttgataggttggttgggaataaggtgagaactttttaatgagggccatgtgtgcaccacatatcatagcaaaataggagttcaaaactaagcagacaagcaacaatctaagcacaaatttataacagcagaagaaccagagttggagagaaacgagggaggtagccaggaatcaagaggaaaaaattctgaagggcaaataaagatgggagaatgaagtagaaaaattgttcaaaaatcagcaaagctatatggggaataaaataatacaataaacatgactacaccaccaatgagagatgccatcaccaaagaggtgagaatacatgaagctcgcctgtcttccgtttgatttttttttttttctgtgtctgccctttggagtaggaacaacttctcatgcatagtagaggcaaaaaccagcatctgatagttccatgtcttcagtgtggagtagaaagcaggaaagagtgggtagatcccgagtgcacaggaaatgcacttatgttcactgaaaagccatacagcatccaactatagatgacattggctggaaatatagaatcacaaaaattattcacagatcttttttttgctgaaatcattttaaataaagtctgacggggagggagagcatcagcataaatagctaatgcatgcagggcttaatacctaggtgatcagttgatagataaaggaaaccaccatggcacacgtttacctatgtaacaaacctgcacgtcctgcacatgtatcctggaacttaaaattttttaaaaaaagaaagtatgtgggaaaaaaaatatcttacagagaccagagatttttttcttttcaatacatttctttagtttttgttttaaccaaaacagagttccaacagttatctcttcagtaaatgaaagcatctccttaagctttaagtggtacttgaaattttaaaagaggattattttttccaactcagtgaggttataatatacactccaacaactttataaaagcaagagaagtagagtgttaattgttaattatatgaaagtgttcaggcaaaggaacttttaccttgaaagcctttactctttagcatcaaaataagcttgaaagttctatggtatttagggaggatattttaaatttcccctacccaagaaaactggataaggattaatacaaaaccccctccagaatattaatttaattaagtagttatccaaagtgttatcacaaatacatgatgtgagttcacacttcaggcccttacatttttatattgcatggcatttgtctttttaattaaaaaaaccccacagttctattgtattgccatggggtttttcatttaattttccatttaaaagtagttttatttctccttttaatttaattaaaaacgttaaaattgttagggaaaaaaagaagaaaatcctgagtcatcactctttccttccttatttattcacattattgatgaaggtctgtctagaacaaaccactgatagcacattatcctttgaaaggcagtgaaacaccgaaaattggagtttgctcactttgaggatcatcgaaaacaaacagctgaaatatttttttccttttagaaaattaaaaaaaaaactgatatgaaatttcctctatttagaagcccatgtctacccaaaaatagaaaaaaatgttttctcaaaagcccggaattagaacatcttacgacatcttcaactctaagttgaatttcattaaaatattttgttgcacgtttttgaagtggcaaacatcttgctttttggaaatctcagttttaagaaatgaaagaggtaaagagtatttgaattataatcattgtctaagccaggatcagttttctggggtgggagtacagagagatgcatcgggtagggggctagtggtcatggctaactgttataaaacttctattgatgccacccatttggatgacatgagattggatatgggctaagacttttgttgaaaggaacgttgtttacttggaagtgttccagtaggcatttgccagtcacagaatacaagaaagaaaaagggagtcattcattttatttcattaaaacatgtgttgaacatctactaaatgctgtaatctgtgctaggtgcagaagatataataataaaaccagccaaaagcgtgattctcatggtcgccagattgaaaaggggcttatcagttacggaagactcaatgcttccaaagctttaataccacccactttttattgaccgtttattaacccattttggctaggaaagggagtgaaagaatgtttacatgcatatttatatcactatttacataagatattttttctaataacacttgaaattgcgtttttaaattgttttatggaagaattttgagcccaagctggtacggtagcttactcctgtaatcccaacactttgtgaggcccaggtgagaggatagcttgagcctggaagttcacgaccagcctgggcaacatagtgggagcttgtctctacaaaaagataaaaaatttagccatgcatggtggcatgcgcctgtggtcccagctactcaggaggccgaggaggaaagatcacttgagcccaggagatctagtttgcagtgagccgtgattgcaccactgtactccatcctgagcaagagagtgatgccctgtcataaaataaaataaaatgaaatagtaatgtataccagcttttatttacctctattcttttttttttttttggtccaaagcatgtgtttcctttaattttttttctttaacttttattttagatatgggagtacatacacaagtttgttacatgggtatattgtacccaggtagtgagcataatacccaataggatgttttttgacccttcttccccaccctaagtagtctgtagtgcctattgttatcatgtttatgttcatgtgtgctcaaagtttagctcccatttatacgtgagaacatgcggtctttggttttctgttcttgcattaattcacttaggatagtggcctccagctgcatccatgttgctacaaaggacacgattttgttcttttttgtgactgcatagtattccatggtgtaccacattttctttatttgatccaccactgatggacacctaatgttgattccatgtctttgctattgtgaatagcatgggtgaagaagatacaagtgcatgtgtctttttggtagaattatttgttttcttttggtagaattatttgttttcttttggatatatatttagtaatgggattactgggtctgttttacattctttgagaaatcttcaaactgctttccacaggggctgaactattttacattcccaccaacagtgtataaacattctcttttctccgcagcctcaccagcatctgttattttttgacttttcaaatagctgttctgacttgtgtggatcatatcttattgtggttttgatttgcatttatctgacaattagtgatgttgaacattttttcctatgtctgttggctgcttgtacatcctttgatctcgaactcctaaccccaagtgatccacctgcctcagcctccccaaagtactgggattacaggcgtgagccactgtgactggccttgtacatcctttgaaaagtgtctgttcatgccctttgtggtttttacttgttgatttgattaggaatcttaagttccttatacattctggatattagacctttgtcagagcatagtttgcaaatattttctgccattctgtagattgtttactctgctgatagtttcttctgctgtgcagaagctctttaattaggtcccagttttcaatgtttgcttttgttgaatttgcctctattctgaaaaattctgtcacgtaccataaatattttgttgtagtaagttaggtaacacatttaaataattagctcaacatcctgaaatatggactactgccaaatggatacaagaatatatacaaagagagttctactccttgactgcccagtcaagttgcacacacacactgttcagatgggtccttggactatgtcaaatcacattgaagtaaacagtagttggtgattagattaggatgaaatataaaatccataaaagtaatcgcataaaacttttaaatggcaaaactgcaattacttttgcaccaacctaataaatagtttctctttattaggacatgcagatataataattagcctttctctgatcggtatggtctagatcagagatcagagaacgtttttgttttttttttttgagacagggtgtcgctgtgttgcctaggctggtcttgaactcctgggctcaagtgatcctcctacctcagccttctaaagtgctgggattacaggtgtgaactaccattcccagcctcagaaaacttttttacgtaaagggctagattgtaaatgttttcagttttatgggtcatgtggtttctgtcacaactattcacattctgtcacaactattcacagtcatgctttgtagcttgaaagcagtcacaaatactaagtaaataaatgcatatggctgtgtttatataaaacatgaggggatagatttggcgtgtggtccatagtttgccaaacactatctagacaacataaaggttcaaaggaggaggatatgacatcaaattggggcaatgagaaagtatttcattgaagaggtagcacttgctattattcttgaagcctggtagatgaggtaagctgacattgtggggtgatttctggtggacagaatgtggatagtttaagaaattgaatttttatgaacactgagcatttcgttatggcagaaatatagactctgtgtagaggagtgactctagatgagttaggaatgtagatttgttcatgttttagagttttcagtaccaggatgaggaacttgtacctagcttgacaggcaattatagaccattaaatagtttatatcacaatgggatttggtagaaaccacactggaagacagtcattctaggagtggtgtgtggaataaattagagaagtaagggactgtaaacaagcgagcggattggaagagtgtcataatagcttaaaaaggagacaatgagggccccaacatagtcaggtaagaggatttctaaaaaagaggttgttgaggtaaactgtaacattctaaaaattatttctttaattgacaaaaatactgtatataattgtgtacaacatgttttgaaatatatatacattgtgaaatacctaaatctagataattaacataagcattacctcacctacttatcacttttgtggtgagaacacataaagtctactctaagcaattctaaagaatctaatgcattgctattaactctagttatcgtgttgtacagtatgtctcttgaacttatttctcttatctaagtaaaattttgtatcttttgaccaacatattgccccccacagccctggtcgctaccattctattctctgcttctaagaattcaacctttttagattccacatataagtgaggtcatgaggtatttgtctttctttggctgtaacatttaaggatgaacaactgggaacctaaattatttccaagctgtagtcccaccatatgcaccagtacttttaacggagcctgcctagttcctgtttctagaaaactattcagtaaaacagccgtcttctatgtattatgtatttttcctaagtcgttacctagggactagaaccctgcctagatccctgtgcccagtgcttcaagccgccttaactatcttgtaatattggcctctatgaatttttaagtagcagaatcagctcccctgagattagtttatatctccccacctggagtggactgcatcttgggtctttgctcaactatcactggagacattcacatttgctgggcggcattgtgccgacccatcatattgatctgtaacgtttagcctgtggttgggcaatttcttcctgcaactattgtatcccactatgtcaaacaaacatcaggtcccatttctacttactccagcctcttgtaagcaactacccatactacaggcctgaatactgagatttgccatacttcagctttttttaaaaactgaggagtaagaattatagacatttgagctactcctccttgtatgtgtactaataccactatgcaacttgtctattaatattattacatacaatttgaaattatattcaaaatagttaacagcctggtcattgacccatcaaaacacttgccagacataaataactgcttgcttaccagctagaaaaatcagccctgcctgtgacacagaaataaaccttcacaaaaacactaaagagaagagctaaaactatgaaatgtccaaaagaaaacataagagataatctctgtgaccttggagtggaccaatatttcttaaatatgacacaaaaagcatgaacaagataataaatattcatgttaaactttatcaaaattaaacactttttttttcttcaagagatattattaagacaacctaaaaccaagccacagacttgggaaaagtattttcaaaatataaatcagatgagggcttttatccagaacatagaaaatgtataactcttgataataataagaaaaacacatttaaaaaaatagcaaaatatttgaatagacacttctcgcaagaagatatacaaatggccaacaagcacataaaaagttattcaataccattagtcattagggaaatgcaaattaaaaccacatagaaataccacattgcacccactagaatggctagaatccaaaagactgacaatactaaatattggcaatgaggtagagaaactaaagttgtcacacattgctggtgtgaatgtaaattgatataaccactttggaaaacacttttgcaatatatttttaaaattaaatatactatggatatactatatacgtaactataaatacactatatacatatataactatacaaaaatgtactgtgtatatatgtggaaatatatgtatattgcataaaacccagcaactccacacctagatatcttcccaagaaacatgtttatacaaacacttgtaatttaatgtttagactagcagtattcagagtagcccaaaactgtaaactctccgaatgtccatcaactagtgaatagataaacaaaatatgatataggcatacaatggcatgctactctccccaaaaagaaataaattactgatatatgcaaagacatggattgatctcacaggcattatactgggtgaaagaatccagacacaaaagtgtaggtattttattatttccattatatgacatttctagaaaggataaaactatagagacagaggcaaaatcagtgggttcctgggaccaggggtagaatcacagattagctacaaattggcatgaagaaactttggggtgatggaagtgttttaaaactgggttattgtgatagttgcacaagtatataagtttactgaaactcattaaactgaacatgtaaaatgggtgaattttattattatatgtaacagaaaagctgttgaaagcatagaatactgttatatgaggagattatttctgtttaaaggtgatttttctagaaagattttataatgtctaaaatataaaactggcacatcatagaatgagtacatataagtaaaactttttttttgcaggcatgcatatgtgaaattgtatggttctatttatggcaaacagaaggaaactttttacagtgaaactatgttcatagttttcaagggaaaaacagctccatgaaataaaatattgcttggggagttctttcataccgcttgtcaccagcattctcactggcttataagttataattgctctgtgataaaggcgtatgctttccttctctcttataaaaattttaatgagaacttggagtgaactctcactgaacctattttcattccaaaaatcttatgattttaatcttatgatcctcctgagacctggcactatggtctgtgacagcatgaatacttcataattattcctcctgtttgtagaaaacaccatgggcatccatcattccctctctcccctgctgcctccagggagtcacagcctctagcaaggtcagtaattgcagttttggttgacagttccaggccagctgaagcaaatccagctggtgaagactagccacaatggatattgactgacttcccttccttctttcacctcatagtcagtttggccttaaaactcttccttagtgatgtgatagatggacttaaatcatcccacaagagattccccagtacagagaaaatgaatggtttctctagagccatgtgtatatgtgtctgtcggtatttgggggacaattgatctaaccgtcctggggtaactgaaaggtctttcccttggggataaggaaaagactgtattggagcttgacatttaatattgtttggcatctcacatctctgtagataacctgcatgaaataaaagattcagccatgtgaattaagatggtattttggaagtggatatgcttcatttggctaacatcgaaaattctaataacagatttgccctgtgcatagaaaaaatagatgctttagatgtcaagcaaataattaagcattaattttttactttattttatgacaaatgcatagagagattcacacaagaaataccaaaggaatgccagatgctttatcaaaaaaaaaaaaacccacattatgaatccaaagaaagatagacaaatagccttcatagtatgtaatattggatggtatagctttacgaaaaagaagataaactttcatgtgaattgctggtgaattccagaaaagaaatgactttcgaaagtggtataatacctttaactctctaacttctcaccatgtggtttactcatagtgtagaccatgactaaagtaccggcagaaacaaacccaattaggcatggcctattgtatagatactgaactagtctagtgtctttaggtttgtaataagtcagggtttatttttttcttgcttttttaccctggtcccttgtttctggacttacttggggtttaaaagatgtatttgcttaagaataacttaattacccattctggataaaaatttaatggaatgtgttagaaggcttaagtgagatattaaaattaattgaaatcacgacccccacactctttgacacacctcccattatgaggtagattgtgagcggccttatagttactccacttaatagaataaagttgatgtgatgttatgtaacttccagactaagttagaaaaggtcatttagcttctacttggttctgtctagagacatactctgggggaaaccaacaccatgtaaaaagctgtcccgtgaccaccatgttgtggaggccccgtgtaggaatttcagccgacactaccgaccaacagttagcctccacttccagccctgtgagtgagtcatcttggatatccagcccagtccagtctttatgtaactacaaacctacctgatatttaactccagtcccctgagaggtgccaagtgagaactcctcagccaattccttctcaaatatttgtctcacaaaatttttagaatatctttaatatatgtgtaatagtaaaactactgtcactcagtaattttgatattaactgtatgtttattttggatattcagtttgttatgtgtctatttaaataattattgaatttctattaggaacacttgttcagcctatctaccatgagacttaaaaagcctaaatcacagtccttgccttagaagaatacaattgtcagtggagtagatgcaggatcatcaagtatcaaaactctggagcacaccattcatattatagtctatgtaaatggtctcccttgagttgtgcaatgggatgtcactggaaagataagacataaagtgttattttagtaataaccattcttatactggtaagcttctcaggattggtatatatgagtggtaaggaatactactaaattttatacttttccaaacttctttacagtactctgttgttgacaaaagtgaaaacaatttagttagaatgtaaaagtaacaaagaagttttaaaggaatatataatgttctgtcataaagacacaggcacatgtatgttcatcatggcactattcacaatagcaaagacatggaatcaaactaaatgcccatcaacagtagaatgaataaagaaatgtgctacatatatacaatggaatactatgcagccataaaaaagaatgagatattgtcctttgtagcagcattcatgtagctgtaggccattatcctaagcaaactaacacagcaacagaaaaccaagtacctaatgttctcacttataagtgggagctaaaccttgaggacatatggataaaaagaagggaacaagggcctactttaagatgaagggtggcaggagggtgaggatggaaaaactacctattgggtactatggttattacctgggtgacaaaataatctgtacaccaaacacctgtgacacagaatttacctgtataacaaacctgcaacatgtaccccttatcctaaaataaaagttgaattcaatttaatttaatgcaaaatataatcaaaattttagtctgggagtagtggcttatacctgtaatcccagcactttgggaggtcaaggcaagaggatagattgagctcaagagtttaaggccagcctgggcaacatagtgagtccctgtctctacaaaaaaatacaaaaatcagccaggcatggtgacatgtgcctatggtcctaagtactttggaggctgagatgggcggatcgcttgagcccatgaggttgaggcagcagtgagccatgattgtgccgctgcactccagcctgggtaacagggtgaggccctgtctcaaaaaaattatattgcactgtatgcaatactttgtaaatgcatatgctattcttctaatgcttttagacacttcagtgcgtgtcatgagaatatgccaagttgactaactataaactgatggttcccaaatttggctatacattgaaatcacctggggagttttaacaaccaactgatgtctggttcccactcccagggattcagatttaatggatcgggggtacagaatgggcattgggattttttaaagatctgaaattgttttaatggacagccacaaccgagaacaactgatatgtatttcttcttttaattaggtagttctcaaactcaactgcccattggaatcatctgtggaacttggcaaactattagtgatttggttccatttctagagactctgatttaattgctctggggtaggtcctcttggtacttttaaaaatgctcactagttaattgtgatttgagatccaccaataggatgctcatactgggtttacagattaatgtttttctgcatatatgtgtcactcagcctcagttaccacatcattactattgggacacagctcaggttgccaaattcagcaaataaaaataacttttcctggataagtttgaatttcagataaacaacaaatacttttttagtgtaagtatgtctcatgcaatatttgggacatacactaaaaagtaagtttttttaatttaaaattcaaatttaaccagataccttgtattttatctggcaactctaaacacagtataatttaggcaagagacagagcaaggcccaaataatgcattatatgaagtgtgaccacaatggtgttcaatccatattccaggacagaactaagatattcttattgtcccccagctgccacagagtaaccattctatcccataatactacttttaggcggtctcatctgtagcatccctcttatttattgagcaaaagcaatggacagatgtaggagacagacagaaaaaacctgaaacctcctgtcccatcagtgttaaatcttttggcaacagagagtgttaaatctattggcagcataagctgaaatcatgggactgaaacttatgacttaaaaaaagacaaacaaacaaaaatcctgtgggtttctattgtttttacttatgcaatttctcaaatattttcatgtaattatagaagagaaaaaaaaacagattagtgctgaagttctgatcactggctgaacttcatagccttagcagccactgttaaacttcgaggttctgtcgcatttatagtgacagccaattccctcagagttacacagcagttgctggcaagtataatctcacatttggcaaatgcttgcatttctgaagctcactttttcattggttcttctcaacaatgctgtgaagtaggcagggaagttatgatatccattatataactaaggaaaattagaatcaggaaagtgttgccttgacctagagtagtatttcttaacgtgtggtcctggacaaactgcctcagcattacctgggaacctgttagagacaaaaattctgaaaccctaccccaaacctactgacttagaaactgcaggataggcccagtaatttgtgtttttataagccttctagtgattctgttgcatggtcaagcttgaaaacccctgccttcaggggtatgtggtcccagctcaaacattactaatactaatgtttatttatttaatttatagtttatttgtccccctggagtttaaaggctgtgaggtcagggatggtgtcacactgcctaggtatataatagatatgcagcaaatattgcaaaataaattaatgaagactagaacgagtgaatgcatgaatcccacatatgggggcttccattgccatgccttgccttaaaagaagtgtcctgtgcttagaaaattccattgcttcgctcattctctcttttgaagaatctcagctaatgggaagaaaaatggttgactgcatgaatttatccacaggcatattgagactagatatttcccttgaccccttagtgggacttgcgaaggggtcgctcacttactcagcctgcagcactcaaaccccttgagggagggggagcacacaggtgagcggatgtgggagagccagggccaagtgcctttgggcaccggcaggaatgaaccttgtactggcctgtggcagagtaccacgtagtacctggaaggcaccttagtttatctagttcagtcctctcattgtatacataaagaaggtaaatttgtgagtggtaaagtctgtatctacgcaataaaatacttcaatagctggggctagaactctgatgcctttattccctttaatatgcaaaggttttgagtacagtgtcctgtgaagaatgcttgaaatctcaccatggggaatgtcaccagtgcaattctgctgtcttttatttttatttttatttattttatttttttagatgcagttttgctcttgtcggcccaggctggagtgcagtggcacaacctccgctcactgcaacctctgcctcctgggttcaagcaattctactgcctcagcctcctgagtagctgggattacaggtgcctgccaccacgcctggctaatttttgtgtttttgttagagacagggtttcactatgttgcccaggctggtctcgaactcctgacctcaagtgatccagcgcctcggcctcccaaagtgctgggattacaggcgagagccactacgtctggccaattctgctgtctttatttctgcttaattattacttttaatttcattattttattacaaaactttaactttttatattgaatggtattattaatatggaattttgtatttataaagtaaagattgaaggaagcgtatttactgctaatggaaagtatcgcttactttttccttcaaagcaggaaaagcaatgtgcaaacatgtaagtgaaggaaaaatccaaccaaatctcttacccgagtatctacattaatattgtttggtgggtgagatatttctgcaattctgcagtattaatccatccttctttattatgtccaccgaaggtgtaacactgattacagtatgttttagggaaaacaatcctcctaggcatagtggcgataattcttcgacttttttactttgctgtcttggctcatcacggtgacctttaattcattttctcttgtctggtcttctttgcagacactacgaagccactctgtggtgtctattgagctaaagtcaattaatcacagggtgacttttaaaaaatcaagattaataataggttatttcatagccagaatgcttgattaagatgggcacatttgtggttcccctcatggctagaaataatttagccaagttacaatatcttgggcaaatttttctctcttataattttcccaatgagaactgctcagtttaaatggacttccctaagcttccatcaggggttctcagaagggttatacaaaatcactttcgttagctactgggtactcctaaatggaagcatctttgtaaagccatgtagcattggcacctcttcacaaaaacttggggggagtccgtgaaaaaaataacgggaagtctgtctttaaagataataacgtctgcctccaacattttacacatctcagtcatgccctgtggtgggagcaaaagaattctcttttctctttagtcttgtgccaaattttcttttcctgttggcctgaatccactaatgtccttggtaggtggatcctggtgtattaaaagattcatagcatttcatatttatattctgcttaacaatatgatggtacaccttagcagtttagcaaaatggcaaatctgtttgcataataaaccatataatgtgctgcatcatcaatttgactttgctggatgaacgaagagaaccagttggctctgatgaagttgagttttacaggtcaatgcaccatccatattaaggaaatccaggacaactatgtacatatatattgtagctagaggctgaatacattttgtacaatatttcatttgctgttataaaagaaaaaaatataagcttgggtacagctaccatagaaatcaatttttaggttttatattattactgcctttctattccccaggtgtgctttttcatagcatctccatcctaaacacaattgcctttgaagtaccaatatatctcttagtggatgacaatttccaaactctactcagaaaatacagtgcaaatcctggtataatataatggaactaccaagagttgttatggggctacatattttctgttctctactctcttgagatcttagcaaaatcccttcttggtaaccttggcttattgaaaagggctaatttatttggcattaatcagaagacatataccatctctcaactagactctctccacaacgttcctttaaaatttttaatctagtgaaaacagggggtagctttattctgtaatagtaatatggttcatgatatggagactgcagaaagaagactgtaaagctgaatttcactgcaagaaaatcgtgacttcaatacttcaggagaaaatcttgttgttcagtttgctggaattaatagttattttacctgtcaaactgtagtaccatcgaagtttcaccagactgtctagaacagactaatttgaagaagtacaatttcccaagtaatgttttattctgcagtccctctcttcagggcaacacacccatgtaggacctctcccactgctagtttagtcatgtgaaagagaatacctcttgttgttgcaagttatttcatcatcatcttgctaaagaaatgtctcactctcctaagtctccaagatcttttattggccagattccatataaggctttgtgttctacatttgtgatctagggaatttaaagcttttcacttctagcttaccagaggcttctgtatgtggtaaatcatacattgatataaaaagtaaataataataatcataataatagttatggcttatgtaacctatctttctcaatagttattggaccatgataagtgatacctcaataccacataccccttcacccaccatccactatctctcatacccttcataaccaagcatctttttttcttatacaattttattaatggagatacaattcacataccataaatctaccattttatttatttttaaaatactttaagtttaaagtttattttatttaatttattttagagatagggtctcactctgtcatggagactagagtgcactggcatgatcatagctcattgcagcctcaaactcctgggcccaagagatcctcctgccccagcctccagaatagatgggactacaagtatgcatcgtgtctggttaatttttttatttcttggcatagacagggtcttctctatgttgcccactctggttttgaactcctggcctcaagcaatccttttgctttggtctcccaaagtgcctggtttattgacatgagccactgtgcctggcctaccattttaaattgtacaatttattgtttttgatatatttacaaagttatgcaactatcactactgtctaattccagaacattttatcacccccaaaacaaaccatgcacctgttcaccaaaaagtgactgaagcaggtatcaatcaatagaagtttatttacccaaagtcgagaaagtaccttggaaaatatacaaatcacaggagcatctgtgatctgggctttttccaaaggagggggtgggggaacttcagtatttgaaggggaaagagcaaataggagggaaaagaaagggagagagggtagcccctgaggtaaatggctaaattctagtgaggctctgtttagcttcagtaaatctacattttacatgtgaaaagaagaactagaggaaaaagtcaattaggcatttgtctcagggtaggcagagggttgataagctggcaattgacattgtcagggttagatttcatagaactgggttttagggctagtatatataggaagggtatgtatcctggaagatttaggtgctcacgaggcaattccttgtgagggaggccatctggggagacatgtgcccttctatagttatgggaaactggcttagagatgaggctatgacacggtgttgctgaattacagctatctgggaacaaaaaggaaggcagcattgtgattccgttcccaagcttaactttgcctttggcatagtaagtttggagtcccaagattctattttctttcacatatccattagcagtcactcctctttccccctccccctaggccctggcaagcacgaatctactttctgtctctatgaatttgcccattttgaatatttcatataaatggaatcatccaatatgtgactttttgcgtctggtttctttcacttatcatcaggatttcatggctcatccatgaaatgtctcagtactttattaccttttatagatgaataatattccattgggtataccaaattttgttatgcacacatcagttgatggaaatttacaattgctttcattttgaggctactatgaataatggtgcatagccagtcatcttgatagagttgtctatactcactttctttttctcctcatttcctatttactcttcagcctactccagtttgatttctgctccagtcacttccctaaaatggctttctctggtgtcaccagtgatggctatacaactaaatcctacccatttttcagtgtatgttgctacctatatctcacagctctaatttgacactgtagtgtagaccatgtcctgtcttcccttgatatgtatgaaagtacactcttctggttttcctcctgtcaccatggctgttgcttctctgtctcttttgcagactcactttttctccttggctagtaaatgtgggatttactcaagactgagtccttgggcaccttttcttttcactcacaagacccattctaggtaatttgacctccacctatgccttcaacaatcatgtatgtgcttttaactacaaatttatgtttataagttagattttggaactgtatacctgtcaaggccagactaatttatttaccctgaatatataaccatcttacatttttttattttcttagaggatgatttccattactcactcagcttgacaaggcacaacatttttaaaaaatctttctgatggataataatcaaatagttaacagctctggacactggctgcctgggttcagatccaaagtctacacatactccccgtgtgaacttggagaagtcacttaacctttctgtgtctgttacctcgtcagtaagatgggtacttttcagggttgatgagatgataacatgaaatgtaaatacgctgaagattttagaatcatgcctggcgtgaactaaatactttaaatgttcaccattttccctctgcctcatctcccatctctaattcttttctttatgtctaaagccagccagacacacagcttcccggtgctttagatataaaggctaaaatgtgtagcctggcctgttgtattagcttcgtagggctgctataccaaaataccacagactgggtggcttcaacaatatcagttaattttctcacagttttggagactagaagtgtgagatcaaggtgttggtggggttggttctttttgagggccatgagggaaggatatgttctaggcttctgtctttggcttgtagaaagccattgttatcttcttgttgtgtcttttcacatcttcttccctctatgtgtgtctctttgtgcaaatttttgttttataataaggacatgagtcagattagattagaggcccaccgtactccagcatgacctcatcttaactaattacatctgtaatgacgttatttccaaataagatcacattctgaggtactaggggttaaagctgcaatatataaatttgagagggatgggacacaattcagcctgtcacgtttggttagtcttctgccagcctctccaggtacatttttactctatgctttctcagcctctcagctagccatccacacagtagccttcttttaaatgggccacaatcttccagcctttccagacctctttctaaaagatatttcttcagctagaacactcttaattccatctcactgccccgccccccaccccccacgacccctcagaacacaggccattttgcatggcttatttctgttcatcattcagatttcaggtcaagatcacttagtgaggaattctctcatcttctaggctggatcaattggattatgaatctatcaaagaatgtaacccctaaagcatttatcttgcttcgtaattgtacatccattacatgtctttttttcaccctgcctatttcaccctgaatgatttgtcttaccctttgatctacagatccttttgagtatataacaggaactcaatcagtatttcttaaatccaaacattacttaagtattgctattttgacaaatcaagatctttactattcactgtaaacagctacttttttcccctcatttttaacacctcatttcctctaataatattgcatgtactttgacatcctttcacttgactgcatccttttgcttgagggaaggtttaagaaaggacgcatttttcatcaggtgttctattcccaacacagaaaagttgactgaatagttcttctttgtttgatatttataatgtcaactgattattatgttcaaggtgatttccaagaataacagacaattagagtcaagccatgtttctgtcccctgaaatcctgaacctatgtgtgttggctaatgtgtgtctttgtatgtacatttttacttactctccaaaaatgtaattgaatgtgaaatttttaactagagccagaattccgtagtaggaatcccaacttctacacttactagctatgcaacctggagtaaactgcctcaggaagtaatagtatttgccctgtagggtgatagtaaaaattaaaggagctaatatttgtgtctggcacggggtatgttaggccattcttgtgttgctataaagaaatacctgaggctgggtaatttataaacaaaagaggtttaattggctcacagttctgcatgctgtacaagcatggcatcaacatcgaagctcaaaatcatggcaagaaggtgaaggaggaagcctgtttatcgcatggtcagagagggaataagagagaaagaagggagaggtcccagactcttttaaacaaccagatctcatgtgaaactaactgaatgagaaagaactcatcaccaagaggatgttgctaaactattcatgagacatctgcccccatgatccaatcatctttcagcaggccccacctccaacactgggaattacatttcaacatgaggtttggagggaatacacatccaaaccatatcgggtagtaagcaccaggtgagtgttatctagtagaaggaggaggagaatacatagaattaacaggactagaagtagtaatatatgtaaagaaatatttcagcacttagaatgacatggtttatccttttatatgcctcacaagaaagaagtctcttttgctcacctttgcatcctcaggacatggcaccatgcctgttagatgctccagaaatatttgttacgtgaatattcattaatttattctttcatttcttaattcatttacaaagagttgctttcattgttttagatttagttgtttatgcttattgtaccagtgcctatttatactacactgcaggtctggaaaaatattacattttaaatttaatttgggtgttgatttggactcactgagcctctgaatacaagcctacttgagacaagtatgtaggatgttcattagttctcaaatacagttgatttatattttataacttgaagtactcctgctttttagcatctatgtgtgaattagcatataaagatatgagtaattgttttaatgaaaatttcacctctgcaccactctactgtgactttattgtgaatgcaattaggtttaccatagcgttctccctgtgagcctgtagataaggcatggaaaaattatttcttttactataatcctcctgcttaaatatgataggaaggcaccaatgaatctaataccattaatgttctctctgaactgaaactccttaaatcataaaatatcacataatgtctttttattaaaatattgacattgtttcaaaatgtgcatttcagagcaagttttatatgcgttcctacaacatatgggcatgttcttcatttggtctttcaattaacatgatgattaagacgaagcgcttatttctgtttctgatgtgttatgtccctaccactagtcacgtttcctataataattcatcacacgttatgaagttttttttttttatgtagtttcttttaagctttcctttaatatatatctgatgatggagacttacatataacagagaagttttcttttggaaacttagcatgactatattttagtttcattagaaagaaagagaattaaaggatggatttttaagaataattcattgtagagttgctatactcaagtactgaagcactttaggactcataagggcatccgtgtcttgcataataaagcagccaagatggagtaaaacgtaaaagcagacatcgaggtcattacctaatctggatggattagccatccagatgcctgaaggtcaaggactgaacaagatatctcaaggtacctacaaattctatgatttcatgttattaggctactgagtataaccagagacaagatggccatgtggttggaaatcatgtagaattacaggttagctcataataaaggcaaaaacaatatgtcggttagaaatttcaagtataagtgaggctaaaagtattttgtgaatggcatcactccatcttttataagataaccctatacatttttctctgtgtacttctattgtaaatgtatagttctattatcacacttgccattttacattattgtcgtgtatttatgtgatgtaaatagttataggtaagtcttatttatctgttctctgtaggacctagcagggtatctggtacagtatgtatcaataatcattagattaatgaactaataaattaaaagtgttataccccattagtaacaaatgacaagtcccaaaatattattttattcaaagtatttgatgccttaatattaactgatttgtacagcccattatacattccaagagggcaagggcagtattaaactgcatccctgaacttaacacgttacctgaaacatagcaggcactcaaaaatactcgaaaaaacaaaccaataatagctttcatttatatagcacttcctatgtgccacacattgttctaggcactttaaatacagtgactcatttactttttacccatattctttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatcccatattcttaactaatacaaaatatgggctctctacatggtatagatcagctgtactttcagtaaatctgtgacttgatttgaaaatggaaaaaataggattcatctcctaagatgttctgtgaatattatataaggcagtgtttgaagcatgcttggcctagcgtctggcatagcagaagttttcaagatatttttactattaagactattattattgctgctattattaaccatctcctccaatagttggcataagagaggttatacaattcagaagacaagaatagagaaagcgaatgctatttgtgtcatcagctatttgttgtgtttacatttctgcccctcatctctatatcctcgtaagcacactccatcttccaagtattcctaggttaggtggcatttaatggtatgtgtagaccctgaagatttgattacattgaaaacagcaatagctaacacttctttagtgcatctctatgtcagtcactcttttaagtactttatatatattaacataaaaacccaaagaggtaaatgcactattattatccccattttatagaagagaaacttgagatactgagtagttatgagaagttacgtgacctgtccagggtcaataagctggtaagcagagcagctggtaggtgaacccaggcagtctggctacaaagttcctatgccatgttgctcagtacatttaaaacttctgtaccaaaaaaatcataaacaaaattttaaaaacagatggcagagtaggaagttgaatttaatagaaaaatatctatgcaaaatacataaagacttgcagcaaaccaaaagaacaaaccacaagtaattcacagaagaaatacaaatagttaaaaataaccaaacaacctcactagcctttaaagatatgcaaattaaaacaagataattttaccctcacaagcaaaaataaaacagaaagaaaagagagcaaaacaaaaaaggaaagtaaaaataggactttgttagtattacctactcaatgtctgcttggtatctccacagggatatgcaatagttatcataagtttaacacacccagaattgagcatctgattccccttcacacctgctccttttacagacttctctatttcagaaaacgtcagctccattcaactagttgcttaggcaaaaatatttagagccctctttgactcctgtcttcctcacaactcacgtgaacccatgagcaaatcctctcagctccattttcaaaatttatccaaaattctgccgtgtagttcagcacctccactcttgcctctgtcatcctgtggctggatggctgtgtccccctgttacatctccccctgcttcagcccttgccctcctatagtcttccgttcaacagccaatcggccagtcgttcctttatgtctcaagacagatcatcactagtccctggtcagaacacccccagggtctttccatctcactaaaagtaaatatagagtccttattaccgtggtcttggagactctgcagacttaaccccatccccttctttcagccccaactcctgcctctctcatcacattttccagccctcttctcccaggtccttctctccactgcgatgactgccttgatctttcttatagttggtttctcatctgctttttctctctgccgggagtgttctttctcttagagctccatgcagttcacatcactgcctccccgtctcaggtcaccgcctgagtagagctccccctactgactgttcctgaagatagcatcctgtcctcacacccttcactgtccgccattccctgcattattttgcttcatcctacttaatattttatatattaaattgttaatttgtttattctcttcttaccccttaaactccttcattgactataatatctgaaagcagaagtttttttttttctttttctctgtctctcactaatgcattcctagcattagcccttagcatgtagtatcttttaaatgaacaaaagaatattcagcatcagctgggctctgtggctcacgtctgtaatcccagcacttggagaggccaaggtgggacaatcacttgagcccaggagtttgagactagcctaggcaacatagggagaccatgtctctacgaaatacaaataaaaataattagcaggtgtggtggcacgtgccttgtggtcccagctactcgggaggctgaagtgggaggatcgcttgagcctgggaggcagaggtagcagtgagtcatggttgcgtcactgcactccagcctgggtgacagagcgagaccctgtctcaaaaaaaaaaaaaaaaattagcattgtaagtgttgcaaaatgtataggaaagtaaattttcacaactttcttggaggattatttgacactacctatagcaatttatttatttatttttaagtttcaatagtttgagaggtacaggttttttttggttacaaggattagttccatagtggtgaattctgaaattttagtgcacccatcacctgcgcagtgtacgctataatgtagtcttttatccctcacccgcctcccaacgttcccccccagtccccagagtccattatatcactctgtgtgtctttgcatcctcatagcttagctcccacctataagtgagaacatatggtatttggttttccattcctgagttacatcacttagaataatggcctccagctccatccaagttgctgcaaaagacactatttcattcctttttatggctaagtagtattccatggtgtatatataccgcattttctttattcactcgctggcccatgggcacttaagttggttctatatctttgcaattgcgaattgtgctgctataaacatgcacatgcatgtgtctttttcatataatgacttttttttttcctttgggtagacacttttacccctctcttgtttggcttcaagccaacaacttcacagaaatcaatctttctttgtcctcgtatgttccctcaatccctaacaaatgttcgatgaccacttcttgtccaaattcaatggctttattgctgttctatatatttctgaccataaaactccatttagtactgtcaatatcaatatttacttttgggggcaataaattagacagtttattaattgaagcatgatatatgtatacacacacatatacatatatatatatatatatatatatatgcatacctttgaatggatctatttatgtacaaactaccaatggaatttggactcacaacatcggttataaccaaaagaatgtgccatcttggcctgatctacccctcctcttttgatatccttctatgcctattcttattaaaaagaataaaattgttttaaaagaaagacaattccactcattatatcacttaatgtaatccttgtgttggcacttttgcctttcattgatatagtttcaaccataataatatatgtaatgaaagtttcaaacttttcagaactgcctatttttggcggggagaggtaatgtgtactaaaggtaatccatattttatgtaaaaagtaaacacaaagaagtaaaaatcagttgcaatctcatcatctctacacatctcttattagtttgatgtttattatctccttttttccattttttcatctaatggagtctgttttacaagctgattttttatatagtacataatagttaatgttattaacataatagtttgctattatgtatactttcatgctatcattttatggctgaatgaaaatgccatttttaaccttgaaaaaaatcttttacttgttctagcagctttcttagttatgttttctttattgcaaaagtaaatattaatagcatccatccttaatacaaattatacttggtgactcagtcaatttaatatataatccaattttaaattttgttgttgttgaattattagatgtttaatgataaataacaaactaaaatattctaaaatcagccaataatttaagtttgtctttacattctctgcttcatttggctaaaatgaatacatctttaaaatgactagataaaatgatagtcatttgtcaattaatgataacctttgaggcttagtatagaagatatattgacaaatgggaggcatgtgccaaagctttttgcattaattgcatcagtatgataactttagtcactacggttccttcaaaatgtattcacataggccaacaaaccttcagtcattttaaaaaagcagtagcatctaatagtccaaggcaatagcaatccatgcacttctgtgacagagagggtgtttcaagaattttggcaaagactcacacttgaggaccaaggcactaaaggtattctaagctcagagagccaacggccattgcctgcttagctgaaatgaggtgctggtgtggagaatctgccctaggttgtataagccttgcacagcctgcttcaaaagagagaactggaggagatctagaggtgttctgagggatgtggtgttataaagagagtccattttaactctgcctcacccctttgtgggcagagctgttaaatggcctggttgctcctgtttttcctgcctcgtggaaactaaccaccacttaagaagtgcaactaccctgatgtgagaagtctacttgcatggtcatgacagaagataactaaatcacaacatctttgtaaattatcacatcatggcctctaactataggttggtgcaaatgtaattgaggtttttgccattggaagtaatggcaaagtaatatttgcaggcaaattgactcacaaaaggctgggcttctgggacacaggaacaattaaatgaagagggaggaaaaggaaaacatttatatgtatatgcttcacctttttaaaaaacaaccgagaatttgttaacattcatattatacttttaaagcattttaatttttcctattctataatacctgaaggatatggaacaattacacataaacatacagaaaattagtttaaaaaaccatccatgttccttctactcatcattaaccactatgaacttggaatataaccttcaaggcatctttctgttcaatttatgtaaatatgtctgattatacacaggtgattagcacagaggcagcataacatattaatgaagaccaaagctctcaagacctattgttcaggttcaagtctcagcatcctctcccccaccatcccttaccagctgtgtgaccttgattcattttcttaacctccctgtatcttatacatatgggtatgatactggtgtttactaatcatggggttgttatgaggatatttaatcacttagacttaagctttctaaagaacttaaaatgttcctggtacatagtatgcacaaagttagtgtttattaaatagaataattacatttcaaaagaaaaatcaaagaataggataaacagtattttaaaacatgctttcttaagaatgtggaataaacattcctcatcagtaaatacacatctatgctattgatttttaaaagctgcatagaatttcattttgtggataaagcatagttcctgattttcatacatttatgtcattccattttttgtttataatacatttcaacttttattacgggactttccaaacatacaaaggtagatcatacagtataatgaaccttcctgtacccatcacccaggtacaataattaccaacacatggtcattccttgtaatatattttaaatactcattttattccatcgattctgataagactaagataatggtcttaaagtgaagagcttccacatcttaagcaacaatattagggtatttgtgtttacgttagaaagacatgccttactctgtcctcaagataatggcttttatctgatgccaaagttaaaaagatcagttcctttattcaactccagtgaacatccttcattatatcttgtttccttctgatatatctgagaagaaaatggaataatttagaagatgccagtgggataaaacactatattcctaaatatagtgcagttttcagagctattttagccactgtaattgaaatcctcttgttctccactgacatattttggaagcccatatgtttagagtctgaaatttcattccaaaaatgatagaaagcctcttgatctcagaatggagagttactgaactgaattaaaatgggcaaaggcttcagtaaacttgaggaagtaatgtatggccttccacgtggattaatttcactctctatcctgggaagtatggtacccaggtagcccgtgtgaaaaatatcatgttggtgatgtccgtatgctaccatattagagacaaagtcatacgttctgcgatgctattttctaggcggtttgtttctttgcattacagtagtatattcggcaccacacagaagttaaaattataagagggaagtaaccttccttagtgagactacaactgtgaagctataactaatagacactaagatagaaataaattattcttatgatatataacataagcatgagcatgtaatattgttgggagctctagcagaaagtactacagtagtagtagttttttttttttttaagacagggcccggctctgtcactcagcaggctggagtgcagtggcacgatctcagctcactgcaacctctacctcctgggctcaagccatccttccacctcagcctcttgagtagctgggactacaggcacacgccaccatacgtggctgatttttgtattttttagtaaagactgtgttttgccatgttgcccaggctgctcttgaactcctggcctcgagcaatccacccgctttggcttcccaaagtgatagtactgcaggcgtgagccactgcacctggcccagtagtccattaaaaaaaaaaaaaaaaaaaaactcattgagcacctactttgtaacaggtactgttgtaggtgctagggataaaatatacttgtttctcctactggatcttgcttttcttggagaaagaaagaaacacaatgtcttagtccattttctgttactataacaaaataccacagacagggtaatttattttcaaaaaagtttattcagctcatagtctggaggatgggaattttaacagcatagtgctggcatctggtgagagccatcttgctatgtgataatatgtcgaagggtatcacatggtgacagggcaagatctttcttcttcctataaagccaccagtcccatcatgggggctcacccttttgactttatctaatcctaattacctcccaaaatccccgcctccaaatacgatcaacatatgaatttgggaattaagtttccaacacataaagtttggggaacacattcacaccatagcacacaataaacgagcaaaaaatactatattagatcataataagtgacatgaagactgatgcaacaaaataaaggaggtaggaggtaccagaggggaagaatggttattgttatttcagatacagtgttccaggaagaaactggtatctgagtagagagttaaaggaagtgagaaagtgcatgttgaaatcggtgacagaggtaaagacaggtgcaaatgtcctgaggcaggaacatatatcatgggcatattctagataaggctttggcttccttatgcttcctttttagtggggaagacagaacgcaaagcaaatgcaaaataaataatatgcagtcaggttgagattagtgttatggaataaaagaagagagagtaaacaatgggggaaggaacaacattaagtaggataatcaggagacttctctggagagatgacccttaccctcagacctaaatgatacactacaaaataaatgcctgtacaatcactaaaggattaacacaaactgaaggtaaaaaccattgtgtaagcgttttcctgaattcaagaattagattattattctgaagctattttaatattgggaaaatcttgttagcatttttttctgacaaagttcaaataatgatttctgaaatttaattctacctaatactaggtgtactttagaaaaataaccaaaatgagctgcagaagtattttactttattataataaatattacagtatgcatcatgaaatgaaagaaaaataatcctttgcctatagttttattatctccaaatgagtagaaactgaatgatgcatttggcaaagcacataaaacttcacttaagagatgtctgttaatacttgctgagtggaaaataatagctagcatttgtttgaacgcttgatgtgtgccaggtgggacactagggattttacaaacactaatccatttaagactcatacacctctgcaaggtatgtagtactattcttcctcctaggtagcctgagtcagtgtcaaagaggattctgtcttgggtctatgtgatttcaagtactgtgctcctttaaccccactcttaattgtgaaaatctttatcacaggactctgaaacttcctgtgattcactttctccatggtgtccacagtcctttcatgctatatgtaccacaaatagcatgaaaggacttccttttaacctaaagcctttttacaattaacccttgcaatttacgctttttgatttttgtggttagtgtctgttcttgtcaaaattgtgaattagagcaagtttctccttgatgtcatcacacttctttgaagtcatcaagcatttagttctcattaggcagaacaggccctggcgactcaaagtgtgagcaggagccagcagcatcagcagcatccccaaatctgctcaacaagagtattaacaagatccccatggaatctgtaggcacattaaagtttgagaagcgcagcgttaggccagcatcagcaacacttgggaccttgctaaaaatgcattatttgtacccgaagctccaggaatgtggcccaagaatctttgttttaacaagccctgcaggtgattctaatgcatgctcctagagagttactctttctcgggattgacatcagcaataccgacctgttgcaataaatcagtcattctcaagtctgtctgcatatgagaatgccctggaaagcttgtagatcccaggttccattccaatatagttggtctcaactatattccaatctgcaggatgggaccatggcattagtgtgttgttcgtttgtgtttgtttgttttcctgtgggctcctcagtgttaaaaatcattgccatagaattagaagatcagtattttaccactctcaagggatttactttttaggagaaattcgaatctccccaaaatagtgcccaaaggactaatctaaacacctgagttaccttcactgactatataactgccacttctgcccttcagcatgacactatgtctctttcctcattgaaaaatacataaaaggggaaattgtaacctctctattcccattggactattgttgagatgaacaaatgagtgtgagagtaggcacttgagaattctcaagtgctatacaaaaaaaaaaaaaaaaaaaaaaaaagctcgtggtctatctgagggtgggatgcagctctgctctgatgtgtaattatggataagtgatcagaagttcagaagttctcagacatcacagggactgcagctttttatttgtttgtggtgtcagctgaaaaagtgctaatgagatacactggggacagcctatggaaaataatctcatgaaatttttagaaaaagggagtatctatgatgatagttctgaaactccaaagctgtgctcctcagactttaatgtacacatgaaactcttggggatcttgttaaacaatactgaatcacaacaacaaattgtgattcagtaagtctagggtgagggctgacagtctgcctttccaacaagctcccaggtgatggcaacaatgctgattcgtagaccacacttttgagtagcgaggggctaaaacatacacaataattaggcctgttattttgcagatgccagtgtgattaatgaatcctgcctatgataacattcacgagtctgccctgaacatttttctgttcttttaaccctgattgcctttgccctgtagctcacatatgatctgtacctcctctttcttgcttacatataatagagcatattttatatatactcatatccagttataattctctaactatgagcaattgttttgttgagttttgttgtcagtgttcatatcataaattgcctcccccaaccttctttcatctctacaattcctttcactcttctttttgaactggcctgtgagtgtgctgttcttgccagattaaatgaatcagtcaatgggaatcttattcttaagtgtattggatcagatatgtacaagtgttgctcatgaggagagaaaagaagatgggcgtgcatgctattgattaatgtagtcacagaaatgcactggtcaatatgatacaagctgtttgcaaccgtaatagtcctgtgctgaggactattaaaaaactgaattggttaccactataaccactacagttatgcttttatttgggtaaaaataatctagcatgttgtggtttagcaacagaatgctgaagaacaccccgatgtgatgtttgaaggagaaaatccaatctattcagcctaatggtttgctacagtagttgaaaaaggcataaaaaatccaatctcctgggtagatgtagctcattgagtggggcatgggctggatttccatacccatcattccttggctagttctcttctgcaggacgtgaccttcacatctcatactgagtattgtgtaatcatcttctggtatctttcttctcttatgtccctttactcattattctttgttccccttttcatctttagtcttcctaagggcttctcagtttttttcacaggggtatatagatcagaaccaagtcctttcctaagcctgtgtctttatttcacaattcaacaaggaaggacactacagatcacatagctcacctccatacatcagagtataggccttactgatacatgcacacatagaaacaacagaagctggcggagcatggtggctcacgcctgtaatcccagcactttgggaggctgaggcgggcggatcatgaggtcaggagatcaagaccatcctggcgaacatggtgaaaccccgtctctactaaaaatacaaaaattagccgggtgtgggggcgtgcgcctgtagtcccagctactcgggaggctgaggcaggagaatcacttgaacccaggaggcagaggttgcagtgagctgagatcatgctactgcactccagtctggtgacagagcaagactccatctcaacaacaacaacaacaaaaaaacagaagccaataaataaattctgcagatctattgtgcagcatggtgactatagttaataataatgtgttgtgtattggaaaattgacaagacagatcttaaatgttctcaccacaaacataactatgagaggtggtgcatatgtaactatgagaggtggtgcatatataactatgagaggtggtgcacatataactatgagaggtggtgcatatataactatgagaggtggtgcatatataactatgagaggtggtgcacatataactatgagaggtggtgcatatataattggcttgattgtggtcattatttcacaatgcatactgttaacaaaagatcatgaaatttgcaggggcaaaaaggagagctttactttcctaaagaaatttgtaggtgggggagacgcccctttgggacagagcaaaagtgtgctccaaggagacactggagagttaaagattataatggcaaaaactgcaagactggggagagggatcagagtcttgattagatgacatttaagcctaaaaccacaaatctctctttgttttctgactctaggtggtcagtggttggtcacatgaggattttccagctgtagtctattttgagattgataacaggaactggtttagcttgattgcagaaaggggagtctcgtgacatttctgcaacattttttgagaacacagtgtatgtgactacctcctcatcttgctgtggcctcccagttctgctttaacttgagcatctcagccacagggggtttattttatctatatgttggggcataatttgacaatacatacttcaaaacattacattgtacactgtacattatacaatttttgtccattacattttggtaaagctggagataagaagaaaggcaagggggtaaaaggagaaacggaatacaagacaagtattaatgaatattttactacatgtaatgtttggttaattataagatgctaagctaaacaaaaaatgattttaaaaatgtcatacacaaaaattattaaaagttttattagatttccattaattcatctttaatgattttacagaatgacaaatgtgatgttttcttcattttaacccagtgtacaagtaatacattttttcttcaaagagtagtttcttataaaaatgtatagttttgttttaattagtaatccaccgaattacatcattataatgttctttataaggggatttattttctattatttaaatttcctctgataaatttttattgtgatatctgccaccaacatcttatagttaaaatagtatgcaaactaatggtcgtgcagatagttactagtataggcttaatactatgcaatacaaggagatgctttcattaggccaatggtttcttatataaaaattacttctttaaaggtctgtacagctagcagaatggcatttgaggggatttaggtctcagcctaattattacctttttagagctaacttctgtgaccaacacagttaaagaagttcaaagatcaccttatttaattttctacataggacttattaatctctgataccatgtggtggtttcatccttgtttaacagtttttctgactctcaatttcaagagggtaggacacttctcattttattattgtatctttaatgtctgtgacaattccaggcagcatggtacataggaactctataaaaattattgaataaatgcatgaatacatggtcaatatattaaaataaaattaaaatttaaaaaaaaagccataaaaaggtaatttgagactgggcacggggcagtggctcacacctgtaatcccagcactttgggaggccgaggtgggcggatcacttgaggccaggagttcaagaccagcccaggcaacatggcaaaaccccgtgtctacaaaaaaatacaaaaattagtcatgtgtggtgacacatgccagtaatcccagctacatgggtggctgatacaggagaatcccttgaactggggaggcagaggttacagtgagccgagattgtgccactgcactccaacctgggtgacagagggagaccgtctcaaaaacaaaaacaaaaaaagataatttgacaaaaatggaagtcgctcaccaaatactttgaataatgtacctactgtgattttgtatttcaagctacaaaataggaaagacattgttcttccttatttttgtttcttttctaacctttttcttttattattctataatatattggcatttcctttagcaaagggagttgtttggccttgcatccttcatacaaatagcaaatatttacacatacacacactcatcgctatgtaagtcccttgaagttcaagtacacagttactcatctgaggtatgtgtgtgtgtgtgtgtgtatatatatatattctgagtgtgtattttgcagctctagttttttataaatgtgtttctcacccctcgtagtcatttgtatgcacttaatgtaattgtcagaagttataaataaatatgtggttgttgtattttcatcattaggttgtaaattccttgtgggcaacaagcatcatataatgaagaaattaaagaaatcagaaccattacattgaaaacatgatgctttcaaatacacttttgaatgttcacctcagtgttctaattaaattctaatttcggtatacatatctccttatctgaatgcctttagcaatttgaagtgactgagtattctgattcatcccatattcaatggaagcatatcaaaattgtctgccatttaactgtgctatcacaagctataaataggacactactctctgccaaaggtgaattaattgtgataaagctatcttgataaaacttattcctcacttaagtgaaacatgcagtacctgattaatttctgcaacagctgtgttaaaagctctgcacttaatatcaaacttctacttcagtatatgtcaccatttttacagaaacagaaagtcccttgcatttgattagcctcaaattatggctcattgatgaatgcaaataatcaaacaaaaaaggactaattgtatagaacaagtaaatattatacatacagtgctcatttgcctacaattacacaggtaatgtctctatttagtttcttaatttctcattatgagacaattgcatctcatctagcagtatttaattgcattgtttctattgctagaataatagcatattcctttttttaagatgttgaatgacaaataaatttagattgtaatcacttattgttccttctctaagcaaaatcgcccaggcgtttcagttgcaatgaaaagttttattttctactaatgatggccaaaatgggagcattctagataagtctgtatcctgtctatcaccttcttcttcagttgtggtcataaccatgatcttaataagtctacttgactaataactttactattttctaaaggtgtcactataaaatcttacaatatttaacctcacataccaaacccctacaataatctttgtttctatttgtaactttacgtgtctgcattggtaaatgtcaggtacatttggaatgacaaacatgcagttacactgagtctagtttgtagtttcttatcctaattctcattctgaccttaacatcaaatcctctactatgagacagcagtattaaataaaactatcacctagcttctgagttatcttgtaagcataagtgaaatcttattcacaaccgtaagtgaagtcttgtaaccgtaagtgaagtcttatttacatgtttacatgtgttttttatgcttcgtgtattttctaaatgattcacttgctcttagccttttgcaaaaagtataattttttattgctgccgtaataaatacaacaaacagtggcttaaactacacaaatttattatcctatagttccataggtcagaaacctggcacaggtctcacttggctaaaatcaaggtatcagtagggcctcatttatttctggaggctctaggaaagaatctatttctttatctttgtcagcttccagaagtttctcacattccttggctcatggtcccttctgctatctttaaaggcagcagttatcagttgagtccttcttacgtggcatcactctgactcttctttcattgtcccttttctccctaactgcagctagaaaagattattcatctttaaagactcatgtgatcagtttgggaccatctgtataattcaggataacctccccactttaaagtctatagccttaatcacattttcaaagtccctttgccatgtacaaggaaatattcatatattttagtgatgaggatgtgggcatctacagggggccattattctgcctactacatatggtctcttattatttagcatgtctagtgcagttgtgtggggatgctggacttcttaacatgtgacattagttaggcttatgaagtcaagcattatagacattgcctgttaatgttgaagcaagcttgaacagagccacgcttcatctctagccttggtttgcttgtttttcctttcatttattattatttttcagtgaaaattgataatagagctgccttttctttttgcactggcattattgcattgcactactgaagaaatcactaaatctgtttattttacagaaaaagattgagggtccagttaaatttgtgtttattcaggacaatgagctctgtttttctcacttgggaattctccctcttgagacagatttcccaggtacgaccaagagttaagagatcaaagttttgtctggtgagaacagaacccaaatctctaggcaactcttgttaactaattttggggataccacagatacagattggagaacttttagaaattcatatcaagtttgatttatttaatattcatatttaatatgttacatgaatgtataatccaatgtaaatacgatttatttattatggaattgtttaatacatgacatgcttatagttataccgttaaggaatatctcttattttgcaacattttacttttttcctctcccaagtgctttgtgaatttcactaaataaatcagggtaaaatgcatgtagtttagtctaaaaatacttaataatccacccagagggaaaatatattttaatgcttgctgcataaccttaataaacagagaatactaatgtgcacttataggttaaagtaatatgtttaaaaatcatttcaacttttattttagagtcaggggatacatgtgcaggtttgttacatgggtatattgcataatgctgaggtttggggtgtgaatgatcccgtcacccaagtagcgagcatagtacccactaggtagtttttcagcccttgtccccttcccccactccccacactagaagtccctagtgtcttctttgtccatctttatgtccttgcgaattcaatgcttagtatcatttttttgaaacagagtctcgctctgttgcccaggctggagtgcagtggcacaatctcagctcacggcaacctctgcctcccaggttcaagtgactcctctgcctcagcctcccgagtagctgggactacaggcacgcaccatcaggcccggctactttttgtatttttttttttttagtggagacggggtttcaccatattggtcaggctcgtctcaaacccctgacctcatgatcttcccgctttggcctcccaaagtgctgggattacaggcgtaagccaccgcgtccggctgcttagtatcatttataagtgagaacatgcaacatttgatttttttgttcatgcattagtttgcctctagttgcatctatgttgctgtaaaggatatgatttaattcttttttatggatgtataatattccatgatgtatgtgtaccacattttctttatccagtccactgttgatgggcacctgggttgattctatgtctttgctattatgaatagcaagatgctggacatttccttaggttttagatggtttcttttgaaatgtatattgttaggtttaatcagtcctttgtatatagttgccttttgtgagaaatacagtaccaggtagcttgatataccattaaaattaagcatatagatttacctgctgtctctaatgccgttatgtgtgacaattcccatatgaggtaaatttaatgagttcgtttcttttaatatctagactaactaatgccttcaggaaagtatgaaagtatattgtgtctctttagtgaattccctttagataggcttaagatagccatatggctctaaacttactaaatgcagaaaatttaacttagctttacttctttcattcttaggaaaacagtcttcattttgttgattaacttccatttaaatgcttattttatactgtctttatttggactatgcttcattaagcctcaatttccatttaattttgcttgtgtcttattgttcgagttcctatgtctcagttcactaatgaaatgttttctaacctgtgaaaattcagaagagcacaaagatccatataaaagtacatttccagtttctaaaagaaaaattaaggtctactgggactctggtacactgcaaaacataaacactattcttactccaaattatagtcattgaggtctttcaattcccagctcccatatgttaaatctacctatctgataatgatattagttgcaaatgctttattgcttccctttgtatcctgtttcagtagctgttccttgtaaccttatcttgacattttcaaattcggtttgaaaatacaactagagtttaccattatttatggaaggtaaatgttaactgacattatatttacatttaggatgaaataggtgaatgctcaggtacaaataaaactaagtttatttatttctctgcttaattcaaaaggtgtataggttcaggtcatagcatagtttagggcaaagaaagtagaaatgagaacacagaacgcaggaatttgtcagttttgtgcatctatctcgtaatctaatctcagctaatgggactttacatttaatcacctttccagaccaagtctccagacccagctgaagttgctgttcatccatgcccaaatctcttttgctgacctcctaatcaagattctagtgtgttagcgataaggtgtggcaggcaataacccagtgatcactattgcttgtttcccccgacagttgtgccctgtttacacacttgagtttctctccttagttctgatttagagccctcggccaggttctcgaaatcactagtgatcttgaattcaaccacatggcttgcattctagcccttgtgcccaaacaacatgatcgaatcatttcaattgaaatacatactatcgctattgcactcagtctccatccctactgtctctgtctctgtccctgtctctgtcttcctctctctctctctctctgtctgtctgtctctccccttgaacaacctggtccttaattccaggcctattctctacaataagttcagacatttttctgcagtccctaagtaggcaaatctgaagacctcctagaacatccagcaagctttgcagttatatcatactgcagctatgaccatgcataacctttatttgacttttatttgaaaccatattttaatatactgtatttattatagagaagtttcttacattcaatgtttctaaatttacctttcacctatatatggtagctccctacatatagaatattaaaatttactgaagtaaaaatgtatttttttctcttttaaagccaccataatttgatacaattaaattatacggtgatatagtttgcatatttatccccatccaaatctcatgttgagttgtaatctccaatgctggaggtgggacctaatgggaggtgtttggatcgtggagacagatccctcatggcttggtgttgtctttgcatcagtgaatgagatctcacaagatccagtcacttaaaagtgtatggcatctccctccacactctttcttattccttttttttttttttttttttgccatgtgatgtacctgctcccccttcaccttctgccatgattgtaaacttccagaagcctccccagaaggtgagcagatgccagcaccacgctccctgtaaagtctgcagaaccatgagccaattaaatccgttttcagtataaattacccagtctccagtatttgtttattaaaatgcaagaatggcctcatacctgtggtttaactgagcacttaattcctttattattttagtgcagatgtctccatttttttcctttgttcatgaaacttttattgggaaaatgctaaatgagagttttactactatgaccacggagagtaggatgcacttgtgcaaagtctgggacctccagaagcttgcaatttaatcagtgaaacagactggacataaacaactctcttaacttctcagtgattggaaatgcaaacagtattctatttaaaaatgccatctggctttcataaggtttggaaaatacttactacttttaaacagcaaatcctccaatatttgaggtttgcaatgctaagcccatagggcatgaggcaacataaccctgatatgagtaattttgatgaattctccatatttagaagtaaattgtgtatcttgataataaattttataatttcattattgagtttcttcatacattttggaaaaaccccacggccctctgatttatttatagctgatttgtcagttagatgtaaaatttcctgcatgttgatcacataacttgcttttcctgtttgatttttttgtcctctataatttttttcagctcctaggtttatagatatttttaatgtagcccatattataataattcaacaattttcaacatctttaaactatgatttaagtatattttgctcattaagaattgctacctcctaaatttaataagaagattgaaagaagaatagctgttgacagtaattaataatattcttccatgtaggagctacatggcaattaattatttttcaggaaattcttttcacttttttgttaagaatatttcattatattatttttcagcactgtcagttttctaacattcatgtagctgttaatttattcataacttgaattcattttcagtgtcattcatgcagctttggctttttttcagcttgcttatattattttgtatatgaaaaatggataactttttgactaatttccttccacattaaaactgtgtagcattcttttctggttctggagaaaatataataatttaaggagatacattatgccatttatttcaatatattttaaaaccagtttattttcatgctatctaaactgctaactggttcatcttaaatttggtgatcctctatagtttaataattgtcagaataaagtgtttgagtaatcaagaatagagctaacaccaatccattagtttatatggtttgtactgattaacatcatcccattctgccatgggccttctcacaaaaatcttaatgagaaagagagacagagacactaaaacagtttagtgagaagtcaccaaaaaatttcttactagttacttggcacgcaataaggttgtccttgccaatgacgctaaccatgatgacatattaatcaatcaagaaatggtcatttatatcaataaatattcagttcttctattatttctcctttgacagtcgtgatttttctgtcagtctacatcaccattgcttccagatgagcctcttttagtccctctctatggtatgcccaagttctattcttcctcactctaggtggctgcaaacagttcttccccctcttggccatgtgtgaaggaggatggaaatgtgatttctgtaaaggctcctgccatttactttgcctgttacattgtctggcatttgcttcatttctatttcatttcttttcattgccctcttcattgtctcttactctcctttcttgtttttgcctcttaatctttattgatttttttctttatttgattccttacgcttagtcctcttcttctgtcattcttaatgaattcattcattttctattgtttcaattgttttctttttttttgttttttaaattgtggttttttcttttttaaaaaaaattttctctttagttttcatcatttaaaaattagcacagatagaatattccttagattaggtgcacacaaatattgaatatgtcattaaataacccgttattttatattatttgtactgattaacaccataccattctgtcccataaattcagaataaacatattgttttttgtatgttgtatgtcgtgtatgtataaagccatcttataagtttcactctgcatatgcctaggttacatattttggcattaagaatatcattaaaagccaactgtttttgagaaaacttttaatgttgggatgtaaaaaataaaccttattgaattcatcataattaaacagatgaatagcagcaataaattcagatcctgaataagaatcaaaccacaaaggttctttgttgactgaaacacaaaaatatgtgtgcattaattttattcttttgtaaagtgttactctaaataaaattactggagataatatcttgggtctcaacaatatcatgctttgcaaagtatttgtcactgctaattgaattttgtgtgtgaatataatgcatatctatacaaatagaacagcctctaattgaatctgggaggatttgaatattgtttgagtgttggccagtctactgacagatttaatcaagaaatggatatttatataaaagaattgtgcttaggagtaataacccatttagtcacagattcagtgttaacggattgaaaggtttgtggtatactctggctctatgagttttaatgaggcttcgtttcctcactttttttttcttttattcaggaagtgttaatgtagcatgcatttcagccttatgattttgtcaaatataatgtttatgttttattcattttggatcccctcctagaactgttattcacatatttgctactacacacatatcagatgagattcattgcagaacacacaactttaggctatatgtcaaatacgaatataaaatacaaatacataggtcagttcatttgtcattcacatttaaaagtggaaggtttaatataatcaattctctaatcccggtacaactgttcccccaaatctgttgaacccagccctctttctgtttgcttcctcaaagtaatgtaatggattttaaaacctatggtaaataaaccagtagaaattgaacttgtctattgaattataatctttgctgtttatttccttctaaacaagtttttattgatatataatatctgtacatattttgggggcatatgtgataatttaatatattcatataatttgtaaagatcaaatcagtgtaattgagatacagtcaccttaaatatttgatctttctttatgctagaaacattagaattcttcttttttctttttctttttcttttttttttgagatggagtctcactctcttgcccagacctggagtgcagtggcacgatcttggctcactgcaacctctgcctcctgggtccaagcaattctccctgcctcagcctcctgagtagctgggattacaggtgcatgccaccacacctggctaattttttttgtatttttagtagagacagggtttcaccatgttggccaggctggtctcaaacacctgatctcaggtgatcctcccatctcggcctcccaaagtgttgggattacaggcgtgagccatcgtgcccagccagaattattcttttgtagttattttgaaatatacaatagattattgttaactatagtcaccctactgatttatcaaacactaagtcttatttcttttatcaaactgtgtgtttgtacccattactcaacttatctttatcccctctttcccttacccctcctggcctcaggtaactgccaatctactctgtatctttatgagatctactttttcagctcccacatatgaatgagaatatgtgatatttatctttctgtgcctggttaatttcacttactaatgacctccatgttcatccatgctgctgaaaatgatttaattattttttatggcggaataatattatataatatgtacacacaatacatggctgaataatatttcattatattatgtatatgtatatatgtcacattttatttatccattcatctattgatgggtacctacactgattccatatttgggctgttttgaatagtgctgcaataaacatggaagtgtagatctctctttgatatatttgtcttttttcttttggatatatacccagtagtgggattgctagataatatggtagctctatttttagttttttttgagaaccctccatacagttttccataatggctatgctaacttacattcccaccttcctctacatccttgccagtgtttgttagtccctgtcattttttaaagaccattttaacatgggtgaaatgatatctcattgttgttttggtttgcatttatttgatgaataatgatattgaaaatttttcatatatctgttggccatttgtatgtcttcttgtgaggaatgtctattctgatcttttgctcatttcttaatcagattatttgtttttttgcggttgaattgtttaaactcctcatgtattctgactattaatcccttgtcagatgggtagtttgcacatattttctcccattctatgtgttgtctctttactttgttgattgttttctttgctgtgcagagctttttaggcggaggtaatcccatttgtctacttttgctacttttgctttggttgcctgggcttttgaggtctcacacaaaaaattctttgcccagagctatgtcctggagcatttccccaatgatttttttttctagtagttttatagctttaggtcttagatttaagtttttaatccattttgatttgatgtttgtgtatggtgagagttagaaatcttttttcattcttctggatgtgattggttatccggttttcccagcgctatttattgaagagactctcctttccccattggatgttcttgttgcgtttgtcaaaaatgagttgtctttaaatgtgtggattaatgcctgtgttctctattttgtaccattgatctgtgtctatctttatgtcagcaccatgctgatttggttactatgtctttgtagtatattttgaagtcaggtaatgtgatgcgtacacctttgttcattttgctcaggattgctttgcttatttgagtttttttttttttttttgtagttccatgtgaattttaagtttttttctatttctgtgaagaatgtgattgatattttgatagggattacattgaatctgtaaatagctttgagtagcattgtcattttaacaatattaacaatattaattcttccaatcaatgagcatgaaaaatctttcattttttatgctttttcaatttatttcgtcagggttttatagttctctttgtgtagaactttcactcctttggctaaattgattcctagatattttatattctttgtagctattataaatgagatttctttcttgatttctttttgagattgcttgctgttggtgtatataaatgctattcatatttatttggtttttttgtatcctgcaaatttactgaatttaccaattctaacagttttttggtgaactctagttttttctaagtataagatcatattgcttgcaaaaaggctaatttgatatcttcctttccaattttgatgcctcttatttctttctcttgcctagttgctctgtctaggacttccattattatatcgaataaaggtagtgaaagtgcgcatccttgtcttgttacagatcttagagaaaatttcaattttttctcacttagtacaatattagctgtgggtttagcatatatgcattttattattttgaggaatgttccttctatacccagtttgatgagaatcttttttatcataaagatatgttggattttatctaatactttttcagtatctattgaaatgatcatgtggtttttgttctcatgtccttgtatcgtatttattgatttgtatatgttgaatcatccttgcatcccaaggatgaatcacacttgatcatggtgaatgatcttttaaatatgttgttgaatttgatttgctagtgctttcttaatgatttttgcatctgttttcatcagcgatattggcctatagttttctttttttgttgtgtccttgtcttgtttttgtattcaggtcttacagaatgagtttggaagtattttctttttgtcaatttttttgaagaatgtaaatagaattagtattggttcttcttcaaatgtttggtagaattcagcagtaaagccattgggtcctgggctattccttggtgggagacatttgattatggctttgatctcattaccagtttcttcacattttctatttcttcatagttcaatattcataggttttatgtgtcccagaatttatccatttcttctaagttttccaatttcttggcatatggttgttcataatagtctctaatgattctttgtatttttgtggtctcaattgttatgttttctttttggttcctgattttatttatttgggccttctgtctttttttcttagtctagctaaaggtttgtcaattttgtttcttttcaaaaagccaactttttgttttgtcgatcttctgtacttttttgccttatgtcctaccattaccagagggtctcctatattccagggttttgtttgtttgtttgtttgtttcaatttcgtttgtttctgcttagatctttattatttctttccttctactaattttgtttttggtttgttattgcttttctagttccgtgaggtgcattgttaagttgtttatttgaagtctttctacttttttgatataggcacttattactatgaactttgctagtagtactgcttttgctgtgtcgcatagattttggtgttgtatttctattttcaatcatttcaagaaagttttcagttgcccttttaatttctttattcattcattgatcattccagagcatgttgctaaattatttttatttttatttttattttattatttgagacagggtttcactctgtcacccaagctggagtgcagtggcacaattacagctcactctagccctgacatcctgggctcaagcaatcctctcacctcagcctcccaagtagctgggactagtggcatgtgccagcatgcccaaccaatttttaaaaatttttgtagagacttatatttcccatcttgcccaggctgctcttgaactcctgggctcaagcagtcttcctgcctcagcctctcaaagtgctaggataataagcaggagccaccaagcccagcctgaatcctttttttttttttttggtatagagtcttgctctgtcaagtgcagacttgacagagtgcagtggcgtgatctcgactcactgcaacctctgcctcctgggttcaagtgattctcctgcctcagtctcctgagttgctgggattacaggcaccccgagcctgaatttttacgtgcttgtgtagtttccaaggttcttcttgttattgatttctagttttattccattgttgtcagaaaatatactgatgtgatttctacttttctgaatttgttgaggcttgttttgtggcctaagagatggtctaccctggctactgtttcatgcactgataataaagaatgtgtacttggtaacagttgggtgaaataatttttcaattctagatagccctatttggtttagtgtgtagtttaactgtgatatttctttgtcgattttctgtctggatgatctgtccattacttatattgaagtgttgaatcccatacttttgttttattgcagtccatctctccttttaaatctattaatgtttgttttatatacttgggagctctggtgttgggtaaataggtatttataattgttccattctcttgctgaacagaaccctttatcatgatgtagtgaccttcttagtctctttttacagtcttttattttcagtctactttatttgatgtaattatagctactgctactcttttttgtttaccagttgcatggaatatcttttcccaacacttcaatttcagtctatgtgtatctttataaatgaagtggaattcttgaaggcagcatatgggtaggacttgtttctttatccattcagcagctttatgccttttaattggataatttagtccatttacgttcaatgttattattgataagtaaggacttactactgccattttgttgcttgtgttctggttgttttagaactcctctctgttcctttcctattgtcttcctttatggttaagtgatttttctctggtagtatgttttaatttgttgctttttcttttcggtgaatgtattattggtttttgctttatagttactatgaggcttatgaaacataattataacattcttttgaagagacgacaacttatcttagataaaaaagaaaagaatagaaacaaataatgaaaatataaaaataaactctacattttagctacatccccccacagtttgactctgttttctcaatttacatagatttatattgcctatctcttaacagcttgctgtaggtattattattatgaaagatttgtcttttgggcttcatactacagttatgtatggtttacacaccaaaattacagtattagagtattctggatttgtttttgtacttaattttaccagtgggttttacaccttcaaatattttctttttgcatgttagttttttttcagatcgaagaactctcttttgcatttcttattaaacagatcgggtcatggttaattctctcaacttttgtttttctgggaaaaacattatttctcattcatacttgatggacagttttgccagataaagtgtttttgaatggcagttttttttttctttcagctctttgaaaaatgtcatcccaccccttcctgtccttattgagaagtctgttgcttatgaacttggaactcctttatgtgttatttgcttcttttctcttgctgcttttaggatctggtatttgtctttgacttttgagagtttgttgattatacaactttgagtaatcttatttgggtcgaatgtattttgtgttctctggccttctcatatgtggatatttgtctcttctcatattttagaaagttttctgttattatttctttgaataagctttctaccccttgaccgactccctcttgaacacaaatagtttttagatttggtctttttaagtaattttctatattttgtgggtgagctatgcttctttttattatgttttctcctctggttattttcaaatactctgtcttcaagctcactgattctttcctctacttgattcattctgctcttgagagcttctcatgaatttttcagtccagcagatatatttctcagtgccagtatttttgtttgatttttaaaattatttctctttgctcaatttttctaataagtttctgaattcactagaaatttttctgtgttatcttggaaatcagtgaatttccttacaactaccattgtgtattcttgttcagagagttcacatatcaccatctcattaaggtcggttactggttccttgcattgtccatttgaggaggtcatagttccctatttgttgtttcttgtggatgtatatctatgtttttggatttaaggatcagttatttattccagtgttccttgttttaatttttattggatgtgtttgcttaaagattcttttaatttacctgttgatttgattttctcttcttcttcttctccttctccttctcctcctcctcctcctcctcctcctccttctcattcttcttcttctttgtgcgtgcgtgcatgtatgctacttccttttcagcaccaggtggttccttaagcacaggtttgctttggttctagtaaaccatcagagtgcttcctgtcctgaatgagggaggtatccaaggggatattgcagtactatgggaaggctatcttgggtttcatgcccagggacctgtggaacaaacttcctacagtatagtactgctgaatggccacctaatttgttgtcttttttttttttgctgagttacagagtagtttccagggctgagaatggtagtctcacctcccctttgtatctctggctgtcctcggggatatttctgtcttcaggtactcctgatgtttccagtgggctgaggcagagacagttctgcccagaaacccaagatggtggggaaagtcattgctcacctcaatctcactttcactagtttggaaaccatgagttgtggggacatttttttttgcatacttggtgccaggtagattagaggagagggagtgtcatggatgtgaaagactgattctcttattctctgtcagagtttcttcacttctctatggccctaagaactgtctcatcctcatatttgagttctgggatattgctggtaataatctcagtgttgtgcatttgtttttggttttctgttgaggggaggaagtaaagccagcttagctctgcatcaccattatgaaaccagaagtctgtgcttatttattattattattttatattttattttttctttctttctttcttttttccttccttccttccttctttccttcctttctttctctctccttccttccttccttcctctctctctctccttccttcatttctcccttctcttccctccccttctctcccctcccttccctccccttcccttccctttccctcccctccccttcccttcccttcccttccttcatcttgctctgtttcccaggctggaatgcagtggctcaatcatggctcactgcacccttgacctcccgggctcaggcagtcctcccatctcagtctcccaagtatcagggactaaaatcgtctctacaattaaaaaaaatgtagagacatagccttgctatgttgcctaggctggatgtgcatctttattcttaaaaaaacaacttacggaaggactcaaaacatatgataccctcaaaagcttccattttagatagtacctatagtgtgttcaagaagctagctaacattctgttgttttctttactgacaaatttaagccaaagtttctaaatatggcattttacatgaggaataagtaggatttagctgtgcctattccagtattgataatacttataatctttaaaaaatagagaaaagtctattgaaaattgtaatagctgggattttcatttactttttttttggacttagcttttgtggtagaaaccacatgacaattagtctgcacaaaatcactgtaaactctatagtatgtacttggagagaacttgtttccttagaaatgctataagatttagggactttaagaaacattttcccacatgacagataacaattttggtggcaaatcttcattgtgaaatcaatctcctccttctactgttttttttaatacttaaaaacattatctggatttatatctctgtcctatagaaagtatgtcaagtgtacctgtggttgtcactcattaatgcacataagaaacacatgaaataagtggattcctgatcccagctcaaatacacttaataagagtatccgactttaggaagcaggatttttccagtttgtggatctgagtctcatgtgaactgttaggtaagaataattgtgatgtatgcaatttgtggacttaactgttcccaaaaagaagggtgtctgtctgaaaggctagcttaaattcaatggttactgaatgaaaataattatttttgtaagatattttctaaaatgtgattggtttatatttgacaactatataaaacaggatttctgaggctaaaattgaattgcatatttggttccaagcctcctaatacccaaagaaaaaaaacaatgaatattatgtgctttacattgtctatataaatttttgaagacatccaggatcatttacaatttctccaagaatattgagccttcataaacttgaaggattgaaacattagaggtgagtcagccctcactaatcccttaagatcaaccagtatgatatggaataagtctttatgtgagaaaaaataaaaataaaaatagaattgatggaggactagagattttgatgctgtaactccttggcagtgtcctacaggtttctaggtacagtcttgcctttctttgattgctaaatgatatttatgtgttattagtcttaccacttttttatatggagaagtcaaaaattagtactctacaaattctaagagtaacttataattctttaaattctttaacatttttgttctgttacaataacatttactaagtacttgcaataccactttatgccagtcacttggttcatatcctcataaaaatgttatagggcagaatatcagtcagagttctaccagggaaacagaacttgtagaagctatatattaagagatttattgcaaggaattgtaccacacagtgatggtggctgataagacaagttcaaaatctgtacggcaggctgtcagaaaatgtagtctggaattctcaggtacaaactgaagctgcagtctacagatggaatttcttcttcagaaaagcctcagctctgctcttaagcccttttactagattgaatcaggcccacccagattatccaggctaatcttccttacttaaactgattatggactttaatctggtctacaaatattttctcagcagcacctagattagtgtttggttgaattaatgggattgtagcctagccacattggcatgtaaaactgaccatcacaggtatgaacttttattgttctaattttacaaaatcaggaaactgactttgaaaaagttaaagtaaattgctacaattgagaaatgatggaacattgaacctaagtttgtccaaacccagaacccatattataaaacccagatggaaagttggcatttgactactaaactattaaagaaatgaatgctgtgtgtgctctggtgcacacacatgcacacacacgcatgcgcccacacgcacacacacacacaccactaccactgccatacagctattcaggaaaaaattataaagggatatttagtacatttgaatgcatgtattaatattgcggagattgaccagcgttttcattaattccgctaggttaattttccttttggaagccatgaaaaatgatctgttcgttataaattagagtaatcttggaagtaatttgacagtcaatcatcatttaataaaattgaaataaaatgtcaagagtaaactgtaaaagacaatgggatcactcatagtaattactgtcagtttaaactgaggaaaacagaatctgatttttaccgttatcagaatgaggtagttagtaatgaaccacaaatgtgaatctgtaaagtattgcatttaatttgttggatttctgcatattggcttaatggatgagtggcataaatttgtaaaaacagttactctcaaacacattatacaatagcacctaaggaaatatttattattctgagattactgattgaatttgtgatacattttattctgctgtgtatgttcagagatagctgtaaagtatgtatctactttgaaaaacaggaaagcctagatggaggacattggctgtcaacagagtgctagaataagcagaaagaaaaataaagcggaaacagaggtacaaacactaaaaaattctttgaaaggtggcatttgttctagagtttcacattttccaatgacacattattttaacttgtccatgaagttgaaatcatttgtgcaagccttgtttcataatttcactattttacttttgttcaaatatcaaaatatttcccaattagaccatacatatacttgcatagcctccctcctttcattatcttctttgtaaaaccaaccatttataatgagcaagacaatatcctcccttgaaaatgttcactttccttatactgtgtctctactcagcatgtgacattgcccatagactgcaaaaaccattctatctcttctagatcacaaactaccatgccatccttaggtcttactaccctccaatacaaacactttcttctagtcatacggggcctttcattcccaccatacttatcctacatatttccagaccaaccaacacctctgctcacattgtgggcctaacagtacactcctgacttcttgccatatatgtgaatactgtcgatctagaagcccagatcctgtaagatttctttattaagcctggtctctttctctactgaactcagataggagatcaaatctgaaagaagcttgaagacaacaggcatctgctgcttgaactccttctttatagtcgagtgagatgatctctacccatggatattatgtttgaaaacctctagtaaaggagaactcattacttttccatcaggttcagtctttggatagttttagaaagtagaaagttcttgtatgtaactattatcatttcttctttacttagctgttcctagatactagactataaacctctttatagcaagagtgtgttttttatttcccaatacttaacacaatactgggcatgcagtagatgttaaaaatactttaaaaaataaataaacctcatttggggttctttcactttcttaaccattcatctctgtataaaccctggtttgcgtatgtgcctcagagcaaatgcacaggtatagtctgacctttctaatccacaatggtctgcacagcctacttcttactcttttctagaaaagcagcctatgttcacattttccaattttccatagcttcataattgctgacaaaaatttctttatacacaattaaatccaaacccaagtattactacttataagacttatttttatttttaccccaagccatatatttcttaccaagtttttgtaacattggtgttttaggatccacatgtagaatacattttattcttattaaatgtatgctattaggcctatgagtctccccatcaagtcctttttgcattttgactctattcttccttattcagtaaacgagccagatttacattactgacaaattgtataataatttctggtgtgaccatattcattttattgacttaaaatattgaatagaagatgaaaacggctggagacctagcattacaagtcagtctctcaatcttggtctgtctttctctctccctctttctcttaaaattgagccattaacatattttagagtcccttagccagttcctatcacataaataaaaattggtgggatgagattcatgataggaatataatgaaatgacatgcactattaaaaataaatggattgatactagaaatgtagcatgtccaatgtaatcatacaacatttcgggggttacatagcacaggcatgttcaaattgttagttatctttattatatatatatataatctctctttctatttagcttcttaattatttaattacaaaatcgagtcttacataaatctgtatatccgtaacatgtaatggtgtaccttatgcataacaggtaaccaactgattgtggtttaatgtgaaaggactcaattgcaatgaaaaagaaagttatttagctacagttttcaagagtaactcccaggaaagaaaaataggtaggataagtactaagaaactctttccgaagctgagtgtaagatttcaagaaaaacgttcaaaaatattattacttcgttctaaaataaaatacattctgaaaaatattaggagccatataaaataatgtaatgatgaatcatactctcaacataaaacaaatgatcagtactttctaattttctataatttgtatgtcaaatctcgttaatatttttttaggtgtgttgtactgttgctgaggttgttttattatttgttttggagaaaaagactgtttagaaggttaaactgatgaattcacagacaattatacaagcttgtgctattaatattgttaaataattgcatacaacttagcacttgagcaagaacaagtgttatttgttactgagtctcttcctgtgatcaggtgattagcattacatattcccaagaataaatgattccacacctcagggatcaggaaaataaccacactttcacagtcagaatgtagataagcgctgtcttgtaaactgtagtaaagccaaacatttatagcatcttttaaagacagtcttatgatctctgaatggttttcatctattagaaattctgtactgtttgtctgacttaatgactcatgaaaatataacctaaaagtgaaaatactgagaacataaaataaataatggttttaaatcagtagtgatattgtcaatttgtgttagtggtctgtacttgcagacaagtaattgggctctcttgtcttaattttgtttcagttaccaatatcactatccaatttcagcagaaaatgtcagcattaaaatatgttatttattacaaagtaatagtttttattgaggaaaatttcaaaaacacagagaggtgtgaaaagaggaaaaaatatgctgtcattctatcaccttgaccactaagtagaatgaaaataaatggttgttattagcatctatagagtgtctttttgcaaaattttgattatcacctacataatgcttggtaacatcacttttaacaatgcattctgaacacttttatgccattagaaagtctcctatcatattatattatttttaagtaataaaattatatgctacagcagaatttatttaaccaatctccaattgatgggcatttaagttgcttttggtctcttgatgaagtaaaaagattgttttaaaaattcctttttaaaatgattgcatacagttctgagcctggtttcgtgtaaggagtgtatatttgttacataggcattcaaaagagcacacttctgttatctatttaaaattgtagaatcatgttaatgtaatgaaacaaatggctagctagaataagatggaaacttgtagatgcctgcattaaatcatagatttggactttgaaagaattgctattgcatatgactaatgtttcttagcatgaaagttgcttattttagaatagctggaactatttatcagtgcatttgtaaagcacaggtaccttaaaatggatccaatatctgttcatatcctcaattaatgtaatacatttttgactaaattttatttaaaaagaatcaacagaattgatacaaacaatgggtaaagatgacaaacttttttaggtcaaaggtagtcttttacaatttctggaagcttctttaaaatgttatctatcttgcctggtttgatttgacatatgaaatatatttctctatatattttctatgttttggggcataggtgatgtgcagggttacgttggttcataatattatcacaattttaatcaaacccaattacaaaagaaaaatgataatgatcaccttataatttatcgtaaaaattatacatatatatttgtgtgatgtttgatagatttgctcttatgtaagagaattatgaaagttagatagaaacagccttctgaaatataaaatatttgtcctaacttttcctgaatagcagaaactaagtatactaaaataaatgtcttcaagattttcttcacacgttcctcagactttgttttaaatcagacactttcagataacatatgtttaatgaaaacacaatgatgtgctgagttttcattttaaaatgtttttacttaaaaatagaaaagaatttggagaaagtcaagttgtattgttttgttttgtttgagacagagtttcaccctgtcgccaaggctggagtgcagtggcactatctcggctcactgcaacctctgcctcctgggttcaagcaattttcatgcctcagcatccccagtagctgggatcacaggtgcgcaccaccacgcccggctaatttttgtgtttttagtagagacagggttttgccatgttggccaggcttgtcttgaactcctgaccttgagtgatccgcctgccttggcctcccaaaagtgctgggattacaggcgtgagccaccgcacctggcaagttgaattgttatatgcagctatatttatccaagttgcacatatttaatataagcacaatctgattaaaaaaaatcaaagttcctgtctaaaacctaaagaattgtagtgaaatcaatcaagttgttgagcttaactgaacttctttaatgccataaccttgatattcactatttcctttgaaatataatattcccttttgcattatttatgcaaatgccatgccagtgtagtggaaggtgtcacctcagtgcagctatagccagtaacatttcctgttctagtcatagaaactttcatttattcatgttgatttgtaataattctcagtcaatttttcctgggtgaagacatgaatttgatgaaacagtagcagcagaattattgttttggatgtattcattaattttttagttaaactttctactttgagataattgtagatttacatgcaattgcaaaagacattacagagatctcatatatcctttaatcagtttccctcaatggaaacatcttccaaaaatttcttacagtggtaacatcttgatagtacaatatcaaacctggatattgaaattgacatagtcaagatagaaaacattttcatcaccacaaggattcctcctgttgccaattagtagccataccacttcccttctgctgtcactctctccttatctctggcaaccactaatctgttctccatttctattattgtgccaagtcaagaatgttccataaatggaatcatacagtttgtaacctttttcactcagcataattctctggagattcacctaggttgttgaatatatcaatagtttgttcctctttattgttggtagtattctctggtatggatatatcacaatttgtttaaccacttacctgatgaagtatatctggattgtttccaatttttgagtgttacaaataaatttgctaaaacagagcctcactctgtctcccaggctgtagaacagtgttgtcagtggtgtgatttggctcactgcaacctccaccccctggattcaagcgatcctcctacctcagcctcccatgaagctgggactacaggcatgtaccaccacgcctggatgagttttgtatttttgtagagatagggtttcgccatgttgcccaggctggtcttgaattcctgagctcaaacaatctgcccaccttggcctcgcaaagtgctgggattataggtgtgagccactgtgcctggccaaatcaattaattttaaattcaaaggtgatatgatgccctctttgtccttctgattttcagtgttttatgaattgattttagttgtttcagtggattaattctacagtatttgcaacagaaagtataacaaagatctctgacaaggtcatgcctatattgggctgtaggaaatacttacttagctacgtattttatacaaaatactggctactagaaaatgtagacatattaattggttgtgaaaaaattatcttgatttactgtaatggcttttatttacctatgtattcttaaaaatctatggaatgtgttctagatacaaaatagtatatatgccatatagagagaacttacagaattagagaaatgaactcctatgtatcagttatgagtttcaaaaatagagtagtacatcaccatattgaaacaccttggagcatggccttctggatgttatctcccattcttcttttggaggtcaccactattctcaatttgatatggtttggttttgcccaattttgttatataaatgtactaatctgattatattcactgttctatgacttattttttttacttatttcacagattatactatgatggtggcagtatcattatttattaatttccattgctatataatattttattgtatgaatatactccaatttaatgtatctcttgtattcttgatggacatttgggctgtttccattttttttctattattaacagtgttgctatgactatccttatacttgtttcctggtgtagatgtggaaaaatgtctccaggttccatatatatctagcagttgaacagctgagtctatatgcatattttaaagtatattaggtaatactaaattattcttcaaaagtggtgtaccaatttacatagccacaagcatgtgttctctcacatctgtaatcaggccctcagcatttgtttgctcacttttatattattggtcttaagcttattgattcaaaagagtacttcgcatattttggatactaggtgtttgacagtaatacatattgcaaatgttttctcccaacttatggcttatctttttactctctttatggtacctatgatcaaacgaagcccttaatttaatcacatttattatctttttcctttctagtttgtactttggaaagctttttgaattttactagggtttatagcttaagttttatatcagtaaaatgcttaccagaataatgttctttatcttgaatagtagcttgcatttatctaaaaattattaggatatatatttcataataatttctatttatagacatatatccttatgatttttatataaacacataccaaatgtatatatatatatatatgtaacaaagtttcttttaaggtttttaatttcagctatcgacctaaacatgcataaactaccttttcttttaaaatacattgctgtagttagctcctgaaaacacttctacttcactgaagcggtgatgatttttgtgaattttcagccatttgtctttgagttttctctttgaaagaccctgagactttattcagtgatatgagagaaactatggaattgttaatattttaagacatcatcatattcatgatttattgttctttgcacaattgattccaacccaaatgtcccatgaaataaaataacacactcagtgtgatttgttttactaattattatatgtagcaatcacttgactgtatagatcaaattttactttctaaaagctccttccattagtgctaatgtgtttgtccctttcaaaaaatacatctagtaatcattgggcaggtggtgaggaggaacagattagaaaatggttcctctctattttttaaatgatgaagtagaaattctgtcttttatgaacttctgctgtttggtttctaggaaagtatatgcttaattgttaaaatattgaagatcttactgttaactctaatttttccagagagaagaggaagaggaaccgtcattggttaaacgctcaatataggttaggcaatattctggccatatgacctctaatattcttcattcatgcattaattcattcaacaaattttttttgagtatgttctatgtgccaagctgtgttctaggaatcgaggtaaagcagtgaataaaacagacaaagaggcaaaaatcatgattttggtagagcttaagcaataaatatgacagattactgccttagaggtatctagaaattgagaaatgctatacaaaatagcatatggctctgcttgtaaaattttaatgtgcatgtgagtcacctggggatctcgttacaatgcagattgtgattccataggtcttgggtggagtcctaagatgctgcatttctagcaagcttctgagtgatgccaatgttgctggtttgggagcacagtttgagtagcaaagagtatatggcaagtgaggtgggggtcgagcgtggagagtgggagagaaactggctgcactttaaaatatgatgattagggtgtgccttattgaaaaggttataagtgagcaaagatatgaagaaggtgggggaatttagctatacacttatctaggtcaatgaaaccagccagtgcagaagggtgttacatgggagtgtgcctgacaaggaggtcagtgtggatggaatggcatgaatgagaagagtagtagtagatcggatttgagagacagtgggaataaagtagatcttgcagggcttcggacaccattataagttctttggcatttacgctgagatgcggaaccactccagaattcggagcagggaggtgacatgctccaacgtacgtatttaaaaaatcactctaactgctgtatagaaaatagactattataaaacaggatagaagcagtgagaccagttaggagtctgcaaaatatatggtagctcagacttaagtttatagcaggtgagatggtgagaagtgctaatattcagaacacattttgaaggtagagcctagtgaacttattgatgtcttaaaatatgcatatacacagatgtaggctgtgaaagaaagaaaggagtcaaggatgactgcaaggtttgtttgttttttgacctgagtttctagaaggatgaagttggcatcacctgaaatggggaagggctaggttttcaggagcatgtcagaggttcattctctgtatgtgttgaatcccatgtagccattagatcttcaaatagagatgtggagtaggcaattgtatatgagagcctggaattcagcgaaaggaccgtgcgagaggtccaaattttctcttatatcattcttaaaacaatcccttgctgctcatcttttatccacattttataattggggaaacatgttcagaggatatagcaaacattcagtttgtaagaggtggagcagagccccaggacaatctgtagctccaaaggccacactgctgttctgcttcaatagtaaaaagaatcaacactggtcactgcagctggttatgtgtttacttagagcaagtcgaaaatatttttaggcagaaaaattgagttggcagttcatctttttaacttccctacttggctactatagacagattttgttaagtcaatgcttggcagctttccatatgttctagagatgcgtgttcatctgggtgtgacagttttttctaagtcacttctgccatagcttgttaaaggtaagaaaaccatgtcttcactgatcttggggtcctagcgaagaaatgtgtgctttctcagtgttggaagggtagagaatggtaaaatgaacattggtggcctccctgtcccccagtggaattccaaggcatagcctaaatgatttctcagaggtccccagcagggttgattcccggttgctcacagcagtaacctgttcattaataccatttattggcttttcatgcatccttgcctcacattcctcattgttcacttcttaggatcacctcccaagtgaattgtctgaacctaagtccatgtctctggctaatctaagaaaggtgataatgtgaaatgtgcttaactggtctatccatgatagttctttctaatttctacaacagtgcctggcaagcagtctcaataagtatttgccacaccagtgaaggactgttattttccttaatgtttattaagtaatagtagtagttgttactattattttaggcaaatatatttttaataggacacagataaattcccctttgtcactaacactgccaatcttagttctttccttacgttcccagaaacaagagttcttaaaactttggtatgtatgcttctgctattttgacttttacctaaatcacatcattttatacatgtgattatgtaatttgcttttttcactcaaatttatgattttgagttctatcgatgctacatattttctgccttctatctgattaaaaatttcccattctgttttcttcctttatggtatttagcgtttttaaattctatttctattttttagtggttccttgtaagtctttaacacaaatatttgaatttacattttaagaggtactaccagtaatgagctaagatttttatcattgcttaaattaatgagcctttctgttcttaatggccaaatgtaggccatagtttaccttgtctcctagctatccctgtttacttccgtgttttctaggattttagtttgttcttgctcccaaataacaaaaggcttattattattattattatctttattggatcttataattaagttttatttctttcatttgcttattgaactcctttctttaaatatacttttcatgttggggaagtgtctgctttagtcactaggctatgatacttaatctaggtcttaacaagtagggttttgccatgaagagggagaaaggatcagtatgcaagggagtagtgtctgaatttgctttgtatgtgccggaatgtctatgagttaccctttgaacacagctttgtgttgctctcatggtttgtaatgtaatccatggtatggtaaatatgtacatcaaaaataaactaataggaaaagatatgaatatcaaattagaaagtgacccaaaatgaagtgttatctaagacaatacatttaatatgtaaaaatacacatagattcatttgaaaatatttgtcgtatttctttcaaacctcatccaatgtcagcataaacaaatataacaaactagttttcaaattaaatttaaaaatataattcttcatacctggagcctcggtgagtaggcattatgcctgaaattttcaatgtcgatggaccatagatctgcctaattactcctagagtcattggagccaaattgctgggatgagccatcattcccccatccccctttcacaccaatgtgattgtatgccttaattggttctctagttattcatgttatatgatctcaccactaccagtgcttctctattagtacctcagtcttcttgttagcattcttaccaaaagattatcagaaaatccaagttactaaaaacatatctaaaacacaaagcccgtgaacagcacatgaaagctggaagcccttgcacttccagaatcctgcttgcatgcctttcagatcacttacagtagcagaaaaggtgtgcaccatcacgctcagctctaacttgctctcttttgtatatgatgcggtaatcctggctcttagtgctttgggattttggtgatagatgtcatcaccagtaattccacagtccccaaagagttcaactctctcaatcaaatcttaagccatattgttggctccctataatactttaaattctactgtacatttcttatagtgtaatcatgttaaagagggggaaataggcttttttcctcttctcaatgcataatctttttaaagttatctattctgatttctcttgaggtctctttccaattacctgcaagtttgcttttactgtggtgttccctgtattgtgtgtgtcttattccttctgcaagaaggaagtggccaagctgacagattgctaatattaccattgtctaattacagctctattatgtctgtacaacagaattgcatatcatttaagaggccactacagcatttatcagtcgttgtggattctagcctaacttgaccattcatttatttttaatttatttttatttttgccttttttgagacagtatctcactctctctctctcacccagggtggaatgcagtggtgtgatctctgctcactgcaacttctgcctcccaggctcaggcaatcctcccatctcagtgtcccgagtggctgggactacaggtgcataccaccacacttggaaaaaattttaaggtttttgtagctacgaggtcgcattatattgcccagactggtctcgaactcctgggctcaagtaatcctcccacctcagtctcccaaagtgctgagattacaggtttgagccactgtgcctggccttgatcattcatttagacttgcagtctgtgccatgggaaatccaaaagctccaccatgacaaattaactccctgttacagacgtagctgttgtctctccgtatctggagaccctcagagcatttttaaaagcatgacattttaaatgttaatttttattgcccagcaaagttaatcacacctatctatgaagagttaatttccaattaaacagttctctgttcactatctataattccctcaaaggaaccaatcatacttaaagggattcagagcctgttatatttcttatcgtctattttcatgagagtatgtacttattataccagatttctggcatttagtgttatagatatgcaaattccattttaactccccttaagatttccaacacccaaatgaacaattaagttttaacttttcatctgtgttctctctctctctcatctgtgttctctctctctctctctctctcagcacatgctgttaaaactttagtttatgctataggtccttgtagcgacaattttagaaacacccctttcttgtgtttatactattataactttggggtctctaaaccaattctaaatatgcattataattataactttatatgttacattcttatcctacttttgtcttaagataatttatgactgaatatttttgtggcatcataatttaagctttaattttactaaaatgtgctttttggttaacagtaaacagttaatatgctatagtctcctggaaacacacgttcacatagctttttatgagccaggtttttggtaattcagcatatactttactattgaacttgcattcttaatgtgcaatctgatcaagaaaaatatcctctaatatttcttttgggttccaagagcactgtcccctttcccaagtactacattttacctgaaaaatatatgagaaagtatgagaattcttgagcctaaagcatttaaatttgattattttcaaaatttgttaagtcatttcaaactgaaattgaaaataaaattaatttccaaatagtaaaaggataaatgaaactaaatactgttactgagaaaattagtccatctttagggcttcaaaaaacacactgaatgtagctttcactgattatatacacttttaaggttgcactttttctaggtgctaggcagaaaatggagcctgaaaaatatcaaattgcagcatagtaaatcacgtttgaatccaagttttaagttatttgaccagtactttattctttgatgagccctgaatatatttttctcagccataaggtaggcatcatgcattcctaaaattggagttgattttctatgatagtttaatttactagctgctcagttcttctaactgtgcatgttatatgggaagattatttttttatttctttgtaaattcatgtcagatctacccatgggaggaaaatgattcctaactcttctccatttcttttagtgtttattcatatgctgtttctgtcttttctttttgcctttcccctagctgaaacaaggatgaatctataaactaaaaaaaaatctttttctttgtaatattagatagacatattatcaataatattatataatctattgcaacaatcaagtcaccattaaaatgtgtagttttctgagtgtttccaagtatgtaatgtaggacaatgctttaagtctggtttattctcatttcacttggcttttttttttttttttgcatactttgagtatatgttcttaagaatattcttaaaatattttccaagacacatttatgtaagctaatcaaaccatgcaatagataagaactcaatgttttagaactctgtcataagaagagatatatttgtgtatgtgtagatacacacatacatttagcacattttcagagacatatacattatggatttttattattgatttaaattctttataatatgcaattacagatatattttatatcagcttaagcattttaattgcaagatttctgtttaatttgtctgcaaagtactcttttttttctggtcatggtaaatttcatattctttgacaatagcttttgtttattactagaaacacttctcttgggctaggttgttaattaactgtcatttttgtacagggtgtaaaagagatatggaaagaagggtacatgagcaaatggaatttcacacattattaactgttttagtgtcttcaaacttcaaaaacatatattaatatttttgtaccacgtaagttcatcagaagcctgactttaatctctgatttattatatttgaacactgtgaagaagcagtttaacactgaacgaaagtgtcgtaatgcagctttcaaagtggccattaaagacagatctctgcttttctattagtacattttctaagatgactatcattgccattgtagtcagctttgtgtacctttatagagattccagtataaacccagaaacatagagcactgagagaaataatatcagaagtgtttcacctttggctactattgtaaattgacaaatgacattattgcttttagatttttaaaacaaacacactaagtagaacatatgcatccaaatcagtagggtcatttcaaataagtcatactttttgttccagtgattcattagcccaagtacacttgaagttcccattttagaattgctttcacaggccagtttatgaagcagaaaataaagattcatttctttctggttaacacctcatttttggccaaaagtgatatagcccaatataccacgaataccttactgaatctgatgcccaatgaattttaactgtttttaaagttcaaagcaatctttaaaagaatgaagactttcagccattgaaactgtctagaagctgagctatgatatttgaaggttcagtatttacaaatggcatcattactttttctttctagagaaggcactagaaggggggctttcatcagaaatacctggaggttttagagaaggcagattctgtctggaaagtcatgggaactagaggcagggtgccatgctatgatcagtcaagtctctaatctctaaaatgtatttcgaagacacagtttgagcaggttgaataagctttttgtcttgtaggcccaggatatactgcgttaccaaagtccaagccccacaaggaggttattcacctgcccataggtccattagaagtcatctgctgatgtgactgtattggtgatgtggaatattaacgtggaacagaaaactccatgggaaggcttagtgctgggggagagatataggcaaaagagatggaggaaagggttgaaataaggatttgtttagacagttcactggtggtgatttattgggtgtgttttactgctaacccacacatgaagcccctgacatcttggctgaggctggtaatttttttctgacaaggatcagcagaaatgaaggtgccatagcttccagtgctagatatagtagctaaacattatcttcagcagagatgggagttcagagtgtcattgtaaaatacatggaaatacctaatgtaaaggagtctaatgaatgaaagaaataccaaatgaatcttcacagagggaggtaaaagaaaagaagataaaatcaaggctggtgacaaggaattattaaaatagaatatgttattgtatatatttgcctcagagtttataattaggagtccgttgaactctgtttcaggatgtcttcatcatttctttaaggatttaaaatatactgcatctagaaataatccaaattaaaattgatttaatacactccaacaccacattataaaaatcattcactatgaccacctgggtttgatattggaaaatctattaatatcaatcactatattaatagatctaagaaaaaaatatacccttactccagtaatgctaaagcctggaataagacaggaatgaaattagaaaagataaattagaggcataagaactagaaaagaagaagtaaaattccctctatttgcagataacatgatagtatacctggaaaaccctagagaataaatggcaaatgtagctcaaacaatgaaataattcaacaagctagcaatatgtaaatttgacagacaaaattcgacagctaccatatgcaaaattaataatgttaaaatagttggagattagttagaataaattacaaaaatctcacaaaataaacagaaaagataaaataggaataaaattaacagaaaatgtgtaaaacatataagaaattataaagcctttctgaaagacacacagaagtagacttgaacaaatagaaagacattccttgttcttcaataggacatcacaacatcattaagatgccacttctctctgaattaatttaaatttaatgtgatgccaataaaaataccaacatgctttgctatatggagctaggcaagttgaaactaaggttaaaatgaaaaaataatgaacaaaaatatctgggaaaaacactaaaaaggaaaagctatgactagccctaccagatattagcatgtactacaaagcctcaacaaataacagtgtcaatagcacatgaatggacagaccaatggaataaaatcaaaagtcctgaaatagaaccaaatacatatagaattgtaatatataatagaggtgacatctcaaataactggggcaaagttgaacttaataataaatggtttcgtataaaagaggaaattagatgtcttcctcaagccatacacgagaataaacttcaaatgaatcagaaaactaaatgtaccaaggaaaactatacaggtactagaagaaaatattggtgaattattttaggacttgcatgtagggaaggactcttttttttttttttttttttttttttttttgagacggagtcttgctttctcaccaggctagagtacagtggtgcgatctcagctcactgcaacctccgcatcccgggttcaagtgatttccctgcctcagcctctcaagtagctgggattacaggcacgtgccaccacgcccagctaattttttgtatttgggtttcaccgtgttggccaagatggtctcgatctcctgacctcgtgatctgcccgcctcatcctcccaaagtgctgggattacaggcgtgagccgctgtgcctggctgggaaggactttctaagtatgactaaaaattcaaatgccacaaataaaaagattaatacattttactatattaaaaacttcgcatgacaaaatcaaaagccaaaagaaaactggaaaaaatgcatatattgtaatgtatatcacagataaagagttaatgtccttaatatataaagaacttttaaaaattaagtgggaacacagatcctgtagaaagatggacaaaaatataaatagacaatttacaaaaaatatataaatgatccttaagcatatgagaagatgattgctttcactaacaataagtaaaagcaaattaaagctattttgaggtacagttctcacccatcagattggcaataatatgaacatttcacaatatactctgttgagaagctgtagagaaacaagcattctcatacagtgttggaatttcgaaatgttctgaaacaaatggagggggaaatagaaatatctaataaaattacatatgcaatcccactttgacctagcaatctcatttctagaaattagcctgaagatatatctcctacaatgcaaatatatgtacatataaagttattcattgcagcattatttgtaattgcaaaatattggaaactacgtaatagtcaaacctaagatatcagctggataaactatagtacatatacacaataaagtactaggcaactaaagcaataatgaggatctcttgatgaactaatattgagtaatttctaagtgaaagcgaagtaaaagaatgtttttctactatgctgcctttgtgtgtaaaagaaactgaaataagaaactgggcatcactttagccaagtgctcaaaattagtatgtttgttttctgtgctgtgtaaaaaattaccacaaatttagcaacttaacatagcatttattttttctttcagtttctgttggacagaagtctgggtatgacataactggaatctctctcagatccttaacacttgacctcctccataaactctctcacacttacaatgtctgatctctggaagggcttggcccctttgaagccagattgggtaaagttcacccaggatacgctccttttttattaacgcaaaggaaaccaatatgggactttatttatactgcaaaacctcttcacctttgttatataacataacttgatcaagggagtgaaatccaccatctacccgttattcctagagtagggattttacagggtttatgtacaaaggcatggggatcttggagcccctctttgaattgggcctatgacagttaatatcaccaaaaaggggcaaacagacatcttgtgtgtgcctccagatgcaatactcttggcaggatataacaccactgagaaggatatgacagcactgatacagtattcccacccaaactgtataacctgaatttagtcataagagagcatcaggcaacacaaatcgaggtacattttataatataattggtctgtagttttaaaaaaatttcatggtcataaatgatatagaaataatgagaagggattccagattaagagaaactaaagagacatgacacccaaatgtagtctataatactggattggataccaaactgaaaaaaagatattgttataaagaatattatttgatcaattaacaaaattagaatatgaactacagttgaaagtatttgggccgggtacaatggctcatgcctgtaatcccagcactttgggggtctgaggtgggcggatcacctgatgtcaggagtttgagaccagcctggccaacatggtgaaaccctgttgctactaaaaatacaaaaattagccgggtgtggtgatgcgcgcctgtaatcccagctacttgggagcttgggaggctgaggcaggagaatggcttgaacccgggaagcagaggttgcagtgagccgagatcgtgccactgcactccagcctgggagacagagtgcctctgtctcaaaaaaaaaaaaaaaacccaacaacaacaaagaaaatattctattagtgttattagtgttagatttcctgagtttgatcactgaactgtggttatataagagaatatcttttgttcttaggaaatacatactgaaatattaaggggtaaaggaatataatatgtacaacatactctcgtggttcagaaaaaaatactatatgtgattgtgtgtgaaagagagagaaagggaagagagaatgataaagcaaatgtggcagaattttgaagattggtgaatatttgtgaagtgttctttggattgttcttgtaacttttctgtaattttgaagttatttcaaaataaaaatcaaattaacaaaaaacaaaaaataaactacacctaaacatcttagcagagggcctgcctggcatataagttctcagtaaatggcagttaataataatatcactattattacctaattcttgcttacaacttgaatccaatcaaatgaacctatttattgccactaccttgggggtttttattgtatttttggtttaagaatacttagtatttttgtttaaagtctaaaataattttataatataaatgtgtagagtaactggtaaccagaattcctgcaaatttaatgccactgcattaattgattgttttagttttggttccccagaagctgacccctagaacccaagacaaggtttcaagttcacatagtttatgtgagaggaaataccaggagatgttagatgtggggagatgagaaagtgaggagaaggaattgaataaagggttcattattaaccaagttaccactgtaggcaaaagggacttaatcctggtggggaaatctaggagacagtgtaatacatgcttcagactttgcctgcccaaggagggatggaggtagggtatttgtacactgacccccatcggtcattgactgagggcttctggagcatgcaaattaaattctaagcacttccagactgctacagtatcatatcagattcctttaggcaatgggttgcaagagctgacatgtgggagacagggctggatgcatgcaaatgatgaattctgagggtatactggtaagtgtctcacagaatctgctgctttggtgaggcagaaatctgctgaatcagtctccctggtattccaggaagcatgtggagtgattgcagctataattatggtgaaatctacactggaactaggtttctaggaacaaacagatctgaactgaattattattttttccagttgctagctgagcgactttggatgagttatttgttcgaacctttggtttcctcatctgtaaaataggggcagtaacagtttgtcttcataaatttactttagaattaaagacattatgcatttgaaaggttgggcctagaaaatactcagtaagtgctagttttattatgtttgcatctcttatagttactattacttttcacttttaatcagtctgttagagatgattgttcttatcttgaactataagatgcactccaatctgctagattaatttgtaccttggctttaaaaaaatctgttttttttttaatagccattgaagactcagaacaatagggactccaatttgctacctgttcttgaaaatgacaatcagttacttaggaaagcaactttgaaaaatacaaaggaaagtcagagagattggaaccaaataatgaaggtcaagcatcatcaaaaacacaagttgtgagtgacacataaagggaagaaaaataagcatcgtaaggactggattagccatgtttagtatgcttttgaaatatttatgaaataatcacagtttaactgtttaattgcatgagctagatttggttgagtacaagcagaacactgcctattctttctcacttcctctttaaatcaagtcatggtcttgtcctttcctacccatgaatgaaaccgaacgcagagtccatagcttaccagtctcaaagtgtatttgtttcctagggttgtcataagaagataccatgaaccgagtggtttaaaacaacagaaatgtattctcacagttttggaagtccagaagtccaaaatcaaagtgttggcacagccatgctctctcttaaggctcttgagggatgattcttccttgcctcttcttaacttctggtggttgccagcagtccttcactttgttagcttatagctgctttactccagcctctgcctttatcttcacatagcattctccctgtatctctgtgtcttcacatggttattttgttaaaaggactccagtcttattggattaggggcttaccccactctagtatgacctcattttaacctaatggactatatttgcaatgaccttatatctgaagatcacattctgatgttcttggaattaggatttcaacatatcttcgcggggagagggggggcgcataattcaaccaataacacatagataattacagtctaagcccatcagtattcaaaccctaaatcttctccaaaataaacatcccccctttcttagctgaggaccactttgtgcctgaaaggctgcattggagtgagagtgacccgagtgtttatttccctgccccaccttgttctgtccctcctcctctctctctgacaaggatatgactgagtcttccaagattagagtaggtagaaagcgtgagctaaggttgggaggaaatgagaagggagaaaaggatgaagagttattttgattgatggaattattttggctttggtgtcctctgaggcagcagattccaaattctgattcttactctcattaggttgttcccttgcctcctcagaagcccacttactctctactctaaatatctctcacttgtagctaaattgatgcaggtagggcctctgacactaataaccaaatcttcagacccttggtgtctcattctgttgcttagttgggatctctgtatcctccaggcagtcatcttgagtggaacctttcttgaaatgaataaaaatttcttccccaggattgacactgatccaacaataaattcatgaatctgtcctgtgcagctgggtcgatctcataaagcatttattggtcaaagttcagccttaaacagttgtttcttgaattttcaagaggcagataccagtgcccatgatggcctttcaggtttactttttaaactcttcaagcatttcttatggaagttctcttacttaacttgcagtaaggtgaagcacctctcttccctaccccattgactcccaagaagcgatgggcaaatatggagaggagattgtaggtattacaggaatgcagagcactaacaactccctctaaagaaagccactctgttgaacatcttcatctgtccaaagatttcttaaactcctatgaacagcctagcctagagacataacagtctaataaaaacctggcagaacttgtcagaactcatcttttaatattttctaaatgcattgtttttaaagtgcttcactgagatataattcatacacttcaccactcacccatttaaagtacacagcacactgttttttagtatattcagagagttatgcaaacatcactacaacctaattttagaaggttttcatcattacaaaaagaaactccattcccattagctgtcactcctcatatctccctcttcctagccgtgggcaaacattactctactttctgttcctgaagatttacttattggggacattttatataaatggaatcatataccatgtggattttttgtgactgatattttagcataatatttgcagggtcatccattgattgtagcatatatcaacatttattttgatttctaaataatattccattgtatggatatatcacattttattcatccatcagttgatagacatatcaattgtttctgctttgagctagtagaaataatgctgctatgaatgtttttgcacactttttatgtggacatatgttatttctcttgggtatttatccaggagtggaattgttgggtcatatgttaactctatatttaactcttgaggaactgctagattgtattctaaagtgactgtaccactttacatccccatcagccatgtgtgaggtttcctaattttcaacattctcaccaacactcgttttcgttttttatttatcatatccactctattgggtgtaaattgattgtttcatactatcttagcttattttcatagataatccatttgctagagttggaatgtgttcccacaaagttcatgttttggaaacttggttgtcattctggtgatggtgggaagtggggcctttgggaggggattaggtcttggaggctccaccctcataaatagattaaggttgttattgcaaaagttgctttgctataaaagcaaactctcttgcatgtactctcttattctcctgcccttccaccatgagatgaccttcaccaaaagctggtctcatgttcttgtactttccagccttcagaaattgagccaaataaacttattttctctgtaaattacagagaaatttacagtgtgtgatattctgtaatagcaagagaaaatggactaagacaccattgcttctctttaggatgtgcaaatagtttgtgcttgctttatttttctgacttacgagccctctgttaaaactcaaaaatcataagaacagtgacatttaacattcagttaaaatgacaacaatttgaccaaaaggcattagaactctatgcctagagttatcgtaataccatgtgcacaataaaatatgtatatgtcataaggaataaaaagtggagtaaacatgagataatctgactatattctgagtgctagatgtctatgagggctttcaggttagttgcttgttttttagtaataaacacaacagtaataatgatgataatacatagcctatattgctccagccaggtgtggtgactcatgcctataatcccagcactttgggaggccaaggcaggaggatggcttgagttcaggagttcaagaccagcctgggcaacatggcaaaacctcatctcgacaaaaaagagaaattaggccgggcgcggtggctcatgcctgtaatcccagcactttgggaggccgaagcgggcagatcacaaggtcaggagatcgagaccatcctggctaacacggtgaaaccccatctctactaaaaatacaaaaaaattagccgggcgtggtggcgggcgcctgtagtcccagctgctcgggaggctgaggcaggagaatggcgtgaacccgggaggcggagcttgcagtgagccgagattgtgccactgcactccagcctgggcgacgagggagactccgtctcaaaaaaaaaaagagaaattaaccgagtgtggtggcccatgcctgtagtccctgctacatgggaagctgaagtgggaggatggcttgggcccaggaggtggaggttgcagtgagtcaagattatggcactgaactccagcctgggcaatggagtcagactctgtctccaaaaaaaaaaaaaaaaaaaaaaaaaaaattaactccctttattcctatgagaaccccactgaatagacactattatctttaccagttgtcagatgagcaaacttcccccagataataagattaatactacctttttacagattaagtaaaactagggggagattgagaggatactaaaaatatctaatgcataaaaatgtataaggttaaggacaattgttttgcctatctctgcccagatcttctcagatcccttttgaagatttttgttgtctaccctctctctggtttctgtgctctcacttttatcaactagcactaaaggctctttgtggggtaccatcctagggctactgaagctgtacccactcctccaggtgggagatcaaaagcctgggaatttcctgtaaattgttggaaattttcctactgataaatcctttcatgtttttactggctttccctggaagcattctttgtttggaatgagtcacttgtacacaaatcttgatctcagggttagcttaaggagaacacaagaaacagagaaaggaggatctcgataaaatattgaactagtacttagtatgtgaagaaaatgagtgatagtatcaaggtaaaaacaagaacagtagaaaattatcttaaaccagggggaattgacattagaaacaaatggattgtcatgatttgaaaatgttagaatgggctatttactcagaaaaagcttcaaacttgctttctgagaagactttataaatgtgcatagctattttcctgggttagtttaaatgtactgcagtccttctggaactgaataactaaatcagtggcttcccagagcctctacagctctaatagttgtataagagcacaacctatggttgtaaccaatggttaacaatcattaacctaaaaagtaaagcctttttgattatgcattgtgctaagggctttagaattattgttaaatggattcagtccctgctttttaggaacttaagagaaaaatttttaaaagtaaataaaagaaatctaccgtttatggtgtactactaagaagcattaaaacaagtatgagaatcacttcagagaaacattaatgaatttacaaatatcagtatttcagaaaagtaatatctactttgattttacaaatgagatatgtatggacaagaaaaatctattcatgacatgtctactccaaatagcttcattagtatttttcaggcgaaaagaagtaacaaaatgaaaaagaaaaagaaacattacactgcattgaggcaaaagattaagaaataagtttgtcagaaaaatgtgaaggtttgatgcttatctttgcagtaattttaagtaaaatgatgaagaaagaaaaatgtttgtggtgagaatattaaaaaaaattgtaggataaaatcccattatatcactggggaaacaaattaatatttcctggtaaagagcttgatgctaggatctagtgtcagaaacttttcttaaataaatactttttcttcttgaacctttaaacatattttgaactaagcaattttgaaacaaattttattcaagtttcttcaagtaataataaaaggaaatagttatcaagtatacaaataactgatctttaaatatatatatatatatggatattaggaaaatatttgagtaggtgggtaggtgttagaggaagcaggaaagataaaatacacacccttgataaaattgtattatataagcaactgcatatattgctttttattgcttcatacaattttattatataagcaatggctttattatataaacaatggcttatataataaaattatataaacaaaggcttagataataaaattatataaacaaattttataattttaaaattggcatgtagagtacacatataatttccttaaaactgtgttattactttccatcaatcacatggatcatgaagttgttttcagttcttctaaacatgctagaaatgtggtcagagactaaaaaacaggtacaaatatattgttttcaaactttacctgtgcgagtacagaataaagacatatttggatatgcagaaacactgaatattttctttcatggcaccctttcttagaatattatttaatgatattgtctatcagaactaaagagtaaaccaaaaaagaggagagcagtgaagagaagcttcacaattatagctatttgttgggtcccaatactgagcaatctgtcccagttaaaaaaggaaggaagacttcagaatagaaatatctgggtgattttattctaccctttattatttggaacaatataaggaaggaataaatgcagaaaataaaaggataatagaataacaagcatacaagatctcagcacccccttttattggagtaaaaggactacctgatgataaaatgcaaacaattaagatcaaatcaagagaaaacagatcaaaacaaaaagttggggaatgatgaatatttggtaaaaaaaaaaaaaacaacctggtgaagagctgtgaatacaaaaaatacaaaattgaaaataaagactatgagggttgtagttgtagaacagaatgtaaatattataaactttgaaaaagtgaatcaatataataaaaatgggaacatgttgaaggaggcaagaagcttattttctctcctttcacagcaggaaataaatcagtctgacttaaaattgaaatactcattttagaatatcataattgtagcaaaaccgatttcttaatgctgttccatattaatttttcctaaacttctaaaacatgtaaactgaccattaagaaactagtaattatttcacttcatattatttcttaatttatttgcagatacaattacattaactatatttcattcagaatatatgaccgtgtttactaaaatcatattttatctttatctctctgtatggattttagagatagctgggaaaatagttacctgatctttattgtttcttgtccatactttaatatcactttaatattgatttttatattaaaaatatattattttgtaaaataaaccattaaaaaaaaagccaattactaaaagtaacttgaaagtcagtacaactttgtataaagtccctagaaaaccacaaagtaaatttgatttatattatagcaaaatgtgtaatatatataatcttaaaggtttttcttttcttttctttttttttttttttttggagacggaatctcgctctttcacctcaggctggagtgaagtggtgatctcggctcactgcaacctccgcctcctgggttcaagcaattctcctgcctcagcctcccgagtagctgggattacaggcgcctgctaccactcccagctaatttttgtatttttagtagagacagggtttcaccattttggccaggctggttttgaactcctgacctcaggtgatacacccacctcggcctcccaaagtgctaggattatagggataagccactgctcctggccaaggttttttttttttttaaagcaatttagtaacctcccaaattaccactatttcttattttacaaatgtgtagtcttcacccctcttttcagctagaaaacaatttaccttaagtgtatgatcactgtcaaaaatgttagttaactaatagaacttcaacataaaagattataaattaaaagcacaaaatacaattttggcaagatataggtcactcggggatgaagttcagtctaaatagctgcctttcttttgcaagatgcttcagattttgtaaactccttttgctcttaaaagaatatctggtggattcatagccaaaaatctaccagacatgaaaagagagactggtaccaatttcaccgaaactattccaaaaaatcaaggaggaagcattcctccgtaactcattctatgaagcaagcatcatcctgataccaaaacctggcaaggacacaatgaataaaacacccaaaaaactacggaccaatatccctgactaatatagacgcagaaatcctcaacagaatactagcaaactgaattcaatagcacatcaaaaagttaattcaccaagatcaagtagatttcattcctgggatgcaacgttggtttaacatactcaaatcaataaatgtgactcactcataaacagaattaaaaacagaaaccatgtgatcatctcaatagatgtgaaaaaagctttcaataaaacccaatattgcttcacgttaaaaaccctcaagaaactagacattgaaggaacatacctcaaaatactatgagggtcaaaaattggatgcatttcccttgagaatttgaacaagacaaggatgccccctctcactgatatggtttggatctatgtccccacccaaatctcatgttcaattgtaattcccaatattgggggtgggtcctgttgggaggtgattggatcatgggggtggagttctcatgaatggtttagcaccgtccccccttaggactgtatagtgagtgggttttcaggagatctggttatttaaaaatgcgtagcacctccccgtctctttcttcttcctgctctgccatgtgaagtaccttactcccctcttgcgttccaccatgattataagtttcctgaggcctccccagaagcagaagccactatgcttcctgtacagcctgcagaactatgagccaattaaacctcttttccttataaattaccaagtcccaggtatttttttatagcagtgcaagaatggactaatatactcactactccaatgtagtactggtgctagccagagcaattaggcaagtaaaagaaataaaaggcatccagattggaaaagaaggagtcaaactatatctcctcatggatgatattattctacacctataaaaccctaaagactttgccaaaaggctcctggaactgattgacttcaataaagttttaagatacaaaaccagtgtacaaaaattagtagcatttctgtacaccaataatattcaagttgagagccaaatcaaggaggcaaccccattttcaatagtgacaaaaaataaaatacataggaacacatctaaccaagaagatgaaagatctctacaaggagaactgtaaaatattgcaaaaaaaaaaaatcatagatgtcacaaacaagtggtgaaacatcccatgctcatgggttggaatagtcaatatcattaaaatggtcatattgtccaaagcaatctacagattccacactattcctatcaaactaccaacatcgtttttcacagaactagaaaaaaactattctaaaatgtatttggaaaccaaaaacagcctgaatagttaaagcaatactaagcaaaaagaacaaagccagaggcatcacactacccaacttcaaattaactataaggctgcagtagcttaaactgcatggtactggtacaagatcagacacatagaccaatggaacagaatagaggaccctgaaataaagccgcatacctacagtcatctgatctttgacaaagttgacaaaaataagcaatggggaaaggactccctattcaataaatggtgctggggtaattggctagccatatgcagaataataatactggacccctgcctttcaccatgtacaaaaattaactcaaaatgggcaaaatatttaaatataagagctcatactctaataatccaaaaagaaaaactaggaaacaccattctggacattggccttggcaaagaatctatgactaagttctgaaaagcaattgcaacaaaaacaaaaattgacaagtgggacctaattaaactcaagagcttctgcacagcagaagaaactgtcagcagagtaaacagacaacctacagaatgggagaaaatatttgcaaatatgcctctgacaaaggtctaatatttagaatccataaggaatgtaaaaagttggacaaactaaaaacaaataaccccattaaaactaggcaaaagacgtgaacagacacttctcaaaagaagacatataagtgaccaataaacacatgaaaaaatgctcaaaatcgctcttagtcagagaaatgcaaatcaaaaccacaatgagacaccatgtcacaccagtcagaatggctgttattaaaaactcaaaaagccacagatgctagtgaggctgtggagaaaagggaatgcttataaactgttagtgggaatgtaaattagttcaaccactgggcaaagtgctttgacggtttctcaaagaacttaaaatggaactaccttgctccccagcaatcctattactaggtatatagccaaaagaaaataagtcattctcccagaaagtcatatgcacccacatgttcatcccagcactattggtaatagcaaagacatggaaacaacctaggtgcccatcaaaggtggattggataaagaaagtataatatatattatctacgctatggaatactacacagccataaaaagaattaaatgttgtcctttgcaacaacgtgggtgccgctggaggccattatcctaagttgattagtgcagtaacagaaaaccaaataccacatgttctcacttgcaagtgggagctaaccattggatacttatggatataaagaaggcaacaatagaaactggggactactaaaggatggaggggttcaagttttgaaaaacgattgggtactatgctcagtacctgtgtgagaggatcgttaaaaccccaaacctgagcctcacgcaatatacccaggtaacaaacccacacgtgtagcccctgaatctaacataaaagttgaaaaaaatgacataaaattaaaaaataattttgatacagaaaagaacatctgggaatggaatatatttgcttttaatatatatctacaaaagtaagcaatgatctctggtaaagtcatgaggcacggtatccttactggctgggataagagcatgcatcagaaaacaccaacatccaaaacatccaagctcaaaacactaatttatagccatctagatgcttttatattcagaattattatagaaagaaagcctaactgaaatcaggtgttctacatgcttttcattcaccagtgaaattagtccaaatagtgtgagactgaaaccagggatatcagctttcatcatcctgggaaagctcgtgctgcttcatttccttccacttcttgctttccagtcaggtctctggttagcagtccatgcagcccataattatgaccaggggtactaagcatgactttttcactttcaataggcctgcactttacagcaagtagttctgagattattatccaaaaatatctaataaccttatacttggaccaatgggcttgtggaataatttgggttcagataaaactacttcttctatctaaccatatgtcagaatacatagcccaccaaaatctttctaactctctgaatccctatggagagtaacacatagtttagcacttaatctttctctaattatttcctacatgctaattttatctccacaactgaaaagtaaattccctgtgtgcagtaacatgccctaatctttatgaggcagtaccataaacagtgttgagcatatttgatgcctgtttaataaatagttgtttatgattatccgatattaagacttagactcctgattgggagctgctttcagttaacataatacagaaatgaaacctcatgtcttttaggaaacatttctagattcctctccagcctcctctgaattactttaacgcttgatttgaatgactaaaactggaacatctttagaaggaaactagagttgtaaatccctgggaatgacttagggtaaataaacaaagacataactcaggtccagaggccaaaaactcagagttcatgttttcaaatattggccagtctgtctttcatacagctgtgtcagctaattgcccaatagcaacctttttgtttgaccatagcaatctgttcgtttctctctctctctctctctctctctctctctctcagcatttactgatgactgtaagtatctttaggtatatttatcttttctctgagtctgcagggtcccttatgatactcagtaactgtgctctcttctccattgcattcttattgctgagtataatgcccagcacttagtaggtgtttaatatatacgttggaagaatgaataattggatggatgaatggatggatgagagatgaaaatactgcctaatgaaagaaggtatcccatcttattaaaataagtagccctccttccttggattgtctggtgttctaaagcgttttttaaaagacatatatgagattaaacctaatctaggctctctccctgtgcgaacacaataattgaaacacatgactttagagaacaaaatgtgacttgactagctgtctgaatcatttcagggtggcatttaatatctttttaaacaaaagacatatatatatatatataactcaacagtcatttaactttctctgtttctcaattctcttatctctaaaatgatgataatatttgcttctttgtacctgtttcgtagttgaattaaaattttgacccctgccatatgattctgcagcccttccacatctttctgcagatactgacataaggtagagaggtcagggaaaggaccattgtagtgacctagtgaggtgtcagcaatgggacgataaggagtagacaatgtaagaaattcatgccagagtgtgggggtgggaatctatagaacttaatgcagatctcaaaggaaacagaagagtccaaatgattaacattgggtttcaaaatccacaccaaaaaaagattttaaaagttgattctttgttcacatgtctcatatatgcttatacaatagcagcattcaaaagtattttgagtcttatagttacatagatatttttacctaaatttctcctgtagcaagggttcagggactttgttaattttatactttttagcttgtcacccagccctttgtttcctctctctggatgtgcagaaagattttaaaatctatccctgccaaacaattctctttcgtgggaatttggtttaaaccagttctgttgctatggtacctagttttcagttaatggaaaaatacaaaaccaaaataatactgaatttgcagtatatatgtccccactcattgcatatcgacttattcatgttgattggattcgtaaacgatcaaaagttgctcagtgctataaaaaaagtatctaacctacttagaattcacatactgacacttatacctttcaagtgttgtgtgtatctgtgtgcatataaatggtagaagagatggcatggagcagtaagagtttttggaggtgaagaaacctgacattgaatttcagcttagccagctaaaagctaattgactttggacaatcacttattgctctggaccttttttccaatctacagagtgggtattcgtaatataactacttttcaggaatgttattaaaattaaagcaatatgttttaattgcctagaacaatgcctggtacttagcaggtttgcagaagcctactagtgttttcaaatgtggagatgatgtgtgtgtgtgtgtgtgtgtgtgtgtatgtgtgtgtgtttgtgtgcatttgtgtgatagggtgaattgtaaccccttaagactcaaatattgaagccctacccccaatacctcagaatgtgactgtatttggagagattgcttttaaagaggtaattacgttaaaaatgaggtccttaggttaggctctaattcagtctgactgtcatccttataagaagatgaaattaggatacttggaggaagcaccaggaggaggcatgcacccaggagagaccatataaagacacaacagaaaggggaccatctgcaagtcaaggagagaggccttagaggaaaccaaacttgctggcaccttgatattggactcctagcctccagaactatgagaaatttccattgcttaagccactcagtctgttgtactttgttactgcagccctggaaaactaatcctatctatctatctatctatctatctatctatctatctatctatctatctatctatctatctattggacaacaaatgttcgtaaaatagaagtgaaaataacatgctagttttcctgagtctttttctcttcatttactgcctccagtgtatagtttgttattatttactttttactaataccttacatggtataaagaaacacaagtcttaaatgtatatcccaatgaatttttgcatatgtgcacatccatgcatccactacccaaatcaagacttagagcattccttgttccctagcagcctctctcatgctcctccaggtaaagagccattcctcttccccacagtaaatacttgtgacttcttgtgttttatatattttgaacttcatataaatgagtcatacatcactcttttgattctggcttctttcacatagcgtcatgtatgtgaaatccattcattttgctctgcgttaaatgttcactttattcattgctgagagcagtattccattgtatgtacatcctccaatttatttattcattttggtgtcgagcatttttgtagtttccattatttataattatgaataaagttgctatgaacattcttgtaactatttttggtggacaaaaccactcttttctcttgggtaagaagtacatgggaattctataaaatgtttctatcttaatgttacttacaggataaagtctatttttctcccttctgagtattgctttttaatctccctactagaaattctcagtgcttcttaacccggggcaggcatttttgctccccaggggatatttggcaatgtctggagacacttttggttgtgacatcttcggggaggatgctactggtagtgggtaaaggccaggattgcagcaatatcctccaatgtgcaggacagccaccaccaacaaagtcaattatctggccccaaatgtcaatagtgctgctgttgagaaaccctgtatctagaccaatagaatttaattttgtatttttactgagtaggtattcattgcttgaccaacccacatattctttctgatacatcttttttagaacccttaggaagaaagagtaatggcagcagcattttccacccttttctattggggttattaattctcaaaaactatacagcctgactttagtgagttcaaggcatcagagcttgtctttatcaataaatatttccagaaaagggaaatagcatgtgtcctttttaagatggtgatgttgcattctgcgaagaaatatatatataaatatgacataaaaatatacatacatatattgcaaatgccatttctttgcctctatttagaaccagctaagatagccaggcacatggatacttgttctatttcaaaatgtctacagaagattcttgaaattcttcctgtcatttttcccagtctctaaaaactgtgatcaatccattcccctgaccgcatgtcatccattgttttctcaggcaacctcttctcaccttcagagtaactgaaggtatattatattcactttagttatcagaagtacctaaaagaaaaaaatgatcaagttatttccatttccatgagcctgagccttctcctctcccatattcctgccagttcttgcttttgaaaactgagcttaagggcaatattgtaacttgcactttttgctgattttatatcattcatctagctataggtctgacagaggtgattacttagctctccaaataggcaatgatgtgattgccttcatttatttcagtgacattgaaatggaggaatgatatttgttggctttgggctttaaagacatgtggtctgctatatttttggctgacagctggaactagtagtgcctgacactagaaaaccaaaaaagtcagcatttgcccttttcattttgaaaattgaaaatcacaggtaattaatcatattaaatgtgaatgtaacccatttcattgctataaaatcacctcttcaattaaaatttttttataaataattatatttgtgcagcttttagcatactaactttttcgtgagttgttttgtaacttacatattaatatgttttaactctgcttccttaactgcattactcattgttattgatatttgatgtctaaggtccgtgatgcccaaagtcttactatgtttgggagagtcttataaaatgaaggactgtctatattaaaataacaatgagaacctcattgatgataagtgatgtaaaaagagagaataactaatttttcaaaatgattctcaaagaaaaaggtactttctatgattatagaatcatggaaaaatgctggaaaagcttagttctacacttaagctcttgggaaatattttatttaagctgataaccaatattatagagaaatgacaattttggcctattttaaaaatactttcatcttcggtagcattatctaaactctaaatctataatatgtcattggaaagaaaagggttccgtgctttcttaaagacaatttgcattttagtaaagagcactatatcaatcagttcactaaataaggttccaaatatgaagaaaagcaagcataacgtgaagccataacagtcattgtttttaattgtgatcaataatctgtgtcgagaacaagtttttgttaattctagaaaaaagatatgacagacaagttgtccttaaacataagagaaacaagatcgatttcatattcactgtcactgtgggtgacattcttctgaataagatttcaaaataaatgctgcaaaatttcaggataaaaaatagaacattagcattaatcatattcatgctcacttctctattttctccacctttgccttctacagtcttcagctatacaggtgatacgcttgttccatttcaagtcaaatgacaccattagttaattagtgttgcaagtctggcaaatgagatctgaaacgaaacacctgtcctttgaccctaacttgttccttgcttatgcaaatgaagagagcagtttaagcattttaaatgttttatttctcgtattatgctgcaggttttatgctgacaaggaacacttaatgtgtgtgaaactagttctgatcatctggtttcagctttttatttattgaatggattttcagtgctgtcattttctttttacctgaagatcacataaaggttgcacaggtttacgtttgcgcataaggaccagtttggttttaagtttagctgtttgagtaacttcatgaaataaattagaaatatatctgttaaatttacccatatgttaaaatagcttttcggtttatgcattatgactattgcaatatgccacactaatatatgaacatttctataactaatatatgtttttaaaatagaaaattaaacgtgaaaggttttttatgaaatatatttatcagcatgaatctttactcactgagcaccatttaataagcatactgattgtaatgattgcattttctccactaaagttctcaataacaacccttggatataaaaataaattcactttcgttattttaaagcaagtcaacaaaataaaattattttggataaattgtataactgaattttcataatgatttatctcagtaagaatagaaaatattattactgtgcagataaggtggcaatggaaatccaatgagaaataaaggctatgaacattgaatgcaatattgttatctgtttgccttgattcatcaaggggtttccaaaatgtttttacaaagttcttattttcaataaatcacatcataaataaaacctcattaacatgaatagagggttattgccttgaaaactgtctattggaattcttggcgggaaagtgagactagtagttatttatttatgtataggtttttctttgcatatacagtagtctctcctggtccctggtttctctttctgtggtttcagttacctgaagtcaactataatctgaaatattaagtggaaaattacagaaatgatttctaaaatgtaaattgcacatcattgtgagtagcatgataaaatcttgcattgtcctgcttgtcctacccgggacataaatcatctctctgtctagtcaccatattcaagctgtacatgctacccactctttcatcatttagtagccttcatggtatcacagtgcttttgttcaaatgaccctttttttacttcataatggcctcaaagcacaagtacagtgatgccggcatactgttgtaattgatctattttattattagttatcgttgttaatatcttactgtgcctgatttataaatttgattttatcatatgtacatatgtataggaaaaacatagtatatataggcttcaatactgtctgcagtttcaggcattgactgggggtcttggaacatatatcctgtgaatagggagggactactgtgttttatggaaaaatggaaattatttttattagaaaagttttaacaaaaggagagcagagcaaatatttcctgtaacagtgggaaacttgttttgttatgcatatggctttctaggtagaaagaatgcttttggggaattttaaataagttgggatgaaaacttgacttctttaactctaaaagatgctttgaagttttagtttttagtttttgtaatgccaatcgtgtaagataaacaactttgaaaccccatatttcagcttatcaaaaatatttaaaatgttcaatcccaccatttaagaattattatatacagaagtatgcattatacagtaattcctactgggaagcttagagcctttagatatttccctctcttaaagagtgggagaaattccaagttataattttttagtattacatatttcagtgtcaaaaaattctcatgaacaactaaatgtacagaattctctttgatataccaagatatgattttacaacttcttttaatgtaatacattttagtgtctaaaaagcatcactaatttaattttagaaattcttttcttttcttttcttttcttttttttgagatggattctcactctgtcgcccaggctggagtgcagtggcgggatctcggctcactgcaagctccgcctcccgggttcacgccattctcctgcctcagcctcccgagtagctgggactacaggcgcccgccaccacgcccggctaattcttttttgtatttttagtagagacggggtttcaccgtggtcttgatctgacctcgtgatccgcccgcctcggcctcccaaagtgctaggattgcaggcgtgagccactgcgcccggcctaattttagaaattctactcaatccaagtaaagtatatgtattccagacctctgccctattaaaaatggagaatcatattcccaattaaaaaaattataagcacaaaggtttctttaaaaatccttaacttttttttttctgttgacttcttcacttaactaaataaataccaattaaaagtttgctctcatggcattgtacagttgatggaagtgggtcaaatgagtgggagctattttactggtccagggaaaagatgatgatcacttaaatttagatggtgcaaaaggaaaacaagaaaagtgcacagattttgtttgtgggtgattgtttttactgtggtaaataatcgcataacataaaatgtaccatttttgccatttccaagtttacagttcagtggtataaagaatattcacatggttgtacaaccattactaccgtcatatcttcaaaactgaaactctgcacccattcaacgtcttcccacttccactccttctagccccaggcaacaaccattctattttctgtctctatgaatttgatttctgtcggtacctcatacaagtggaattatacactatttgtctttttgggtactggcatattttacttatcataatgtcttcaaggcccatgcatgttgtagcatgtatcagatttgcttctttttgaagctgaacaatattccattgcgtatatatacaacattttgttcacccattcatccataaatgagcccttgggttgtttccatgtcttggctattgtgaatagtgctactaggaccgtgggagtagtggacagagttgaaatatattttgttacgtgctgatgaattgaatatgaagactaataaattgtcagaaatacctatccaaaagtatagaatatgatttaaaatttttttcttctgaatatcatatgatcttttaggatactaactattacataatggaagctcaataaatataattttataaattagtccatgaaaggcatctttaaaaactgctttaaatgtctgttaatccgttagggtatcaattttattggccttatttctgcagtttcaaatttgctttatttaattttctcattaaaattgtttatatttaaggtatatagcatgatgttttgatattcatgtacgtaatgaactgattactacaatcaagctcattaatatattcatctctttaaaagatgctttcttggggttcaaaaaccggtaccccacaatatggcactttgacatgttggactaaagaaacattctcaaggtctctctttcaccccaccccacccctcccagcatctctcaaccttctgtctctctcaaagcacaggatgaaggttttctctgaagttcccttatcagcctgaagcctggacccaccaaagaagaaaacagttacctctggtcccttccctgagtttcattaacttaacacatattgcaggaagaaagacaagtctgtcagcacacctggacagactttcaaaaaactatcgtcttctatttcattcccattcaggatttcaaagagaatcatttaccagctattgtctgctctgcaggcccaataggctttgttccaggccattgtatgttttccaggttcactcattttcccttaaaaatatttactatccctcaaattgccacatttcctccacctcccctccccttatgaagaagaatatataaacatttttaccccactgtgttgttgggtcattctcctgtgattcccctttgccatgcacattaaaatacattttatatgccatttctcctattaatatgccttttgtcagttaattttcagcaaaccttcacaggtgaagggtcaatattacccttggcccctacagttttaacttatttttcaggagacgcacatttgtttttttgtgcatgggtacgtaggtttctgtgatgattttactaactaaatgggacaactatatcgttacataccatggtttcactcattcttttaaaattatttttactactctagttaaatataaataccataaaatttgttattttaaccattttaaaatgtatacttcggtggcattagatacattcacattgttgtgcaacagtttcactcgttttaccaaattgaatgttttgtctactggccaggatttattgattgttgtaatgaaaatcttttcactcatagtttagcaatccttttgtaaatgccctaaatctgtatttattgtataattaaataccttagcaaatacttttaaactgaaaatcccggtgtactaagttcattcatgtttttcactctcctttttttttttttttttttttttttgcatttcagtttggcaagtttctattgattaagtgtcaatagacttttcttggttgtgtcaagcctactgatgagctcatcaaaggcattctttatttctgtcataatgtatttgatctctagcatttccttttgagtctttcttagagcctctatctccttttaattactcatttgttcttgaatcttgcctactttttcctatagccatcaacacattaatcacacttattttaaattctctagtaattccaacatcaatgtcatacctgagtctgattctgatgctcgctttgtcttttcagacaatgttttatctttcttttttgtgtgccttgcactttttgttgaaagccagacattttgtcttgggtcataggagctgaataggcctttagtgttaggatttatgttaatatggctaggagttgggctgtatttaatgatttctgtagctgttaggtgcccatggcttccgtttcctctagtgtgtttgtttttagcttcccagttttcttttgtcttccctaagaagtttttctcagatagagtctgtaacttttggttctttcagctgtaatccactgtcattatactggggccccgttagtttggttgtagagtgttgaggagaggaagcattctatcatcataaattaaatcacagtcttttagtgggcctgtgtccctggactgtgaaacacactcataaacgtttcttagctttttgcttcccctcttaggtgagacaggaaaaccagagggagctggagttgggaaaatattcttctttcagatgggataaggctctgataaagctttttcctcctggaaaataggactgtattatggagaacactcatactctgggcatagttcacaatgttttctcatcctgtccccctgccagaaccaccagaggatcaatcttggctcttcactgtgagaacaggaggggtggggttcttagaggtaaagtacagataactgtagaggccaccaggaaatttctgactctcatactaatccacattcagtttccagcaattcataaaaattacggtttaaggattcttacaagtttatggatccagtggccttttttttttttttattcgagggaaactaattgctgctttgactctgtatttgcctgtatctctgcatttcagtgtggaagtttgctttgtgacctcaattttctgatggatccaagaaaagtcaatgatttttagtttctttggctttttcttgtaagcatgacttcctagctctttacatgttggagctcttgggtggccttttaaactactaactagtagaatggaatgcagtaaaaccaacaaaaacgatggaacaacagagcctggaccattaatcgcgccatccaatctagagtagaaaagacaatgtaagtaaggcaagtgaccttttaggtcctaaaagcaactttatcaccagcccctgtaaacttttaggaaaaaaagattcaaaattataataaataatattcatacatatttgagtgagatcaatgatctggcttcttaaattcttcatggaatatcaattttgacatttctttggctcatttccacagtggctgaatctgttctcagtcagaaaggaaactcgtattttcttttttcaaactttgtaattttccaactttctaatgaaacattgtaggccttcattagaaagattacctcagactaacttactgctagccatgtccttcaacagtgcacctaagataatttattgaagtatcttctctcagatggcaaatgtttcttcattcactctcttagcattttaagttccacagtaggagctatgtaagtctcctaaagcccacaatttttagccctaaagagcattaatgtccctctaatatacagttgatccataatggtgtgccttaagctttcttcaaaaattgcctcaaaaaaaaaatcagtgatgtgaatctgcacttactgtaatactgtggtaactgggagtgggccatgtgtatactcatgtacataaacacactacacattcctagtttaactatttgctaaccctgtccattgattttcacagtatatttttttctcctctcaatagtttttaaggcttcctaaaatacaaattgaaataaccttttgctgcagatattatggaatccaggcaggcctgcaagtctgtgcagagtttactctctggcaataagactgagaatcccctttaacaggccctgccagaccacctgttatatttgaataattcacaaacagcttttcccattaattcatgccaggcctctaaatataatccaaaataagtcatgttataaggcatttggattagaaataaagtcattataaccatatgcctgcatttataaatgtacttttagacaacatagtaccattctaaattttcaccacaggatctgtttgacctacagagatatttgggtatctctaacttaaggaaaaaggccgtgaggcaaccattttaaaatacttacagacagtgagtttgaagaactttgaacttgtagtctcctgatgcctcactgatacatccatttcaaggcagacaattgccttccttaagcccaaagttagaaaaaatgaacaggacagtttttcaggttttgtctcaattcctgttcatgcacagtgcaatttttgccacactatcctcatctcttgaagagatggctagccatttcttctgtgatgtctcaaatgtgcttcaaagttcattgtagcccttataacactgaaacctacctgtgtgcacatctgtctctttcagttctttaaatggtatgagaacatgttaagattagctctataatgagtcatttctgcatccctcagatccctggtattgaacttgacacgtaatttgtatttggtgtggttattcagtgagtaattgacaaattcaatgatccatattatgcatgtcacattttagcttcccttaaagaaaagtttttaggaaaggaaaagaacactggggaggggggaaacaaaattaacttggccatgctgagaattgcaggaatgtgcactatgcaaacaagttaagtaagcacagtgtcttccttacttccatcagagaccttgcttggctaaaaagcaagagtggagcccactctctgtattcatttgcataatttgttcacactctgccttagccacagaagtggaaagcctttcctttcctggtagtccctaggacatgtcatctacctccctcgtgagttgtaatatggggaggactggaaggcacagcttagagccccatggtgtccagtcaggggaacatggggataatgtgtccattcactgacactagcgcttttctccaatatggttaacagtcgaaatttgattaaagcaagttaggaaactccagtaaggctaattttctcttgaactatatatggtgtctgttggcaagaaaacaagagttacacatttaagtaggttaatatcaactgagaaactcttaagaatcatagtttaagatcaggccaggcgtagtggctcacgcctgtaatcccagtactttgggatgttgaggaggatggattgctcgaggtcaggagttgagaccagcctaaccaacatagtgaaaccctgtctctactaaaaatacaaaaattagctgggtgtggtgttgggcacctgtaataccaattacatgggaggctgaggcaggaaaatcacttgaacccaggaggcggaggctgcagtgagctgagatcgtgccactgcactccagcctgggcaacaaagcaagactctgcctcaaaaaaaaaaaaaaaagaaaatcatagtttaagatcaaagttgaatgtatattgtgatgagtctacagtgtgggaacaactttttgaaaagtgtaataggtttgagaaaaatggcttaatttaaaatatgtattttctattatatgtgcatgatttttatgaagatatattctcagaattctttaaattagtggttctcaattcagtctatgtatcagaattgcttgtgaagctttcaattaatacatatggatacctaaacctaacccttgattctgattcatttagtctggagaaaggttggacattttttagcaactttgtttttgatttaggattgaatatcactgccccaggattatgaagaaattcatcatcatcctaaaaatattatagtacttcagccctttattatagtcatttttccataagtggcaaataataagaatccaaagaaacatgttgtgtatgcgtggggccatctcgatacagctgatgacaattaagttgttggctgtctggttttaaagatatttggaaagacaattccttttataagaaaaccaaacaaattccagccaatgaatggtcttaggcggtcaagaattttattctggcttactgacatcctcaagatctcaagacacagattagactatgagaagacacagtaaaatactccatctttattcttagagattctattctgaatcccacttttttcagttttattgagatgtagtgacaaaaaattgtatgtatttaaagtgtacaacacgatgtttcgatgtaagcatacattgtgaagtgattgccataatcaagccaattaacatattgatcatcttacatagtagccatattttgtgtgtgtgtggtgagaacacttaagatctattttcttagcaaatttcaggtgcacaatacagtattattaactatagttactagctgtacattaaattgagataacttattcatactgcatcactgaaactttgtacactttgatcaacatctccccattttccctactctcagccactggtaacctccattctactttctgctcttaggagttttaatttttagattccagatataagtgagattatgcagtgtttgtttttctatgtttggcttattttacttagcataatgtcttccaggttaatctgtgttgtcacaaatggcatgatatccttttttttaaaaaaaaatgctaaataatattttattgtgtgtgtgcatgtgtgtgtatatatatcattttctttacgcatttatctgtgaatgacacttctattgtttatgtatatttgctgttgtgaataatactgtaatgaacatgggagtgcagatatctctcccaatcactgatctcatttcctttggatatacacccagaagtaagatgctgaatcatatgataattctattttttcattttttgaggaacctccattatgttttttgtaatagttgtacaaattttcattcccaccatcagtgcacagaggtctctattctccacatccttgccaatacttcttctcttttcacatttgataatagccattgtaacagttgtgcagtgatatctcattgtggttttatttgcatttctctgatgattagtgatattgagcaccttttcatctacctgttgatcacttgtatgtcttcttttgagaaacatatattaaattctttagccaattttaagtaggcttatttgttgttgttgtttgctattgagttgtttgagttccatatatatttggatattaaccttttatcagatgcatggtttggaaataaatttttcctgtttcataggtagtctcttcactctgctaattgtttcctttgctatgcagaaacattttagtttcacacaatcccacctgtttatttttgctcatgttgcctatatttttggagttatgtccaaaaagtaattacccagaccaatgtcaaaaagcatttcccttatgttttcttccagtagttttaaagcttcaggtattaagtatttaatcaattttgagttggttgttgtatgtggtgtaagataagggtccaattttatttttttgagtgtggatatacaattttcccagcatcacttgttgaacagactgccctttccccattgtttcttagcatgcttgttgaagatcagttgactataaatatgtggatttattgctgagatctttattgtgtttcattgctctgtatgtctgtttttatgtcagtatcatactgttttgtttactatagccttgtagtgtattttgagatcaggaaatgtgatgcctccaagtttgttcttgctcaaggttattatggctattcaaagtcctttgtagttacatatgaatttggggaaatgctattgcaaatttgataggcattacattaaatctgtatgtggctttaggtagtatggacatttcaacaatattaattcttccaattgatgaacatggaatatctttccacttatttgcgtccctggaatagatccaactcagtcatgttttaatttgctggtaaattcagtttgctagtattctgttgtggaattttgcatctatgttcattaggaattttggcctgtacctttcttttcttgtagtgtatttctctggcttttgtatcagggtaaggctggccttgtgaaatgattttgtaagtattacccgcttttcaagtttttggaaaagttaacattaacaaaaaattggcattaattcttctttaaaagtttggtagaattccgcagtgaagccatttgatcctgggcttttctttattggaaggtttactttattactgattcagtctccttacttgttagtgttctgctcagattctgtatttcttaatgattcagtcttggtaggctatatgcttttaggaatttattcattccttctgttagacagtctactttgtgatttgacaatgtattttcagtagtatgctttgattcctttctcttagattttgtgtatctactaattttttttttcattgtggttaccatgaggtttacataaaacatctaatagttagttatgtctattttaagctgacaacttaattttgactttgtacaaaagctctatacttttatttccacctttcacattttatgtaattgatgtgacaatttatatctttttatatcatatattcattaagaaattattaaggctctagttatttttaaaacttttctcttttaacttttatattggagttacaagtgacttatgcaccactattacagtattattctgaatttggctatgtacttacctttaccagtgagttttatatttttatatgtcttgatgttactaacaagtgtccttttatttatatttgaataagtatttttcgcatttcttgtaaggcaggtgttgtgatgatgaactccctcagcttttgtttatcttacaaagtctatctcctcttcatttctgaagaattgctttgctggcatagtattcttggttgacatttttttcctcttgtactccggatatataatcccattctcttatggcctggaaggtttctgctgagaaatctgctgatagccttataaagaatccctagtatgtgatgaatcatttccccttattactttcaaaattctttgacttttgataatttgattataatgtcttgatgtaatctttgagtttttgtatttgtgtacttttgagcttcatgaatctaaatatctatatctatctcaatatttgggaagttttcaacaattatttctttaaataaactttctgcccctttctatatctttctggaactcccgtagtgaatgtatcggttctcttcatgggaagctctaaattctgtaggccttctgtactattttttatttctatgtttgtttctcctctgactgtgtaatttcaaataatctttcttaagttcttatatattttcttctgctttatcacgtctgctatttatgctgttcattgtattcattatattcttcagctccagaatttctatttggttctttttttatgatttccatattcattgaactttttttgtgaattgtttttctgattttgttcatttgcctatctgtgttagtttgtacctcactgagctttttgtaaagagttactttgaattatttgtcaggcagttcttagatctttatttatttggtgtcagttactaccaaaattgtgagttgtttttgttgtgttatgtttccttgatttttcatgttccttggagttttgcattgctgccctcacatgtgaacaaggagtcacctcctccttcaatccttactaactgacttcaggatacaaagactttcattagtcagcctgacattctaggggtctcgcagacctttactatggatacacctgccccactcctcttgtttcctcttcaagaagaagctttatgtttgaatgtcttctcttgatcctgcaaagccaggctgggtgctgactgcctctcttttgtttttcctagggcattgccctgaagtactcaaagttaattgccttctcccagtcccagagagttaagccagatgtctgtgtgtgcttgtgcatgatttgcagaggctatgggtagggatggacagaagggcatgcagagtgcttggagacacatacgagaaagttaaatgggtccacaagtgttgcatcttttgatgttcatgggcagggttcatggagttcatgatgcaatgagtagaaacaatggccctttgtttagttctttactgaagttgctgtgagctctcaccccttttccctgttcttagctttcccaagactattcaactgagccagtttcttctgtgttatgggtgaagtgagataaaagtaggcctcttgggcaacattctgactagctatgctttcactttcccctgtgaaacaaatcgtgggccaagaatgtctctcttggcactgagctgtgtgctgccttgggaaaggggtgatgcaagtaaaatgaaactgttttccttaccctcttcaaggtaatcgtggatcatttttttctcccatggtgcgttgggacctctcccctggtccctgggctctacctaatatacttttgtctgtgggtagttgtcaaaattggtgttgctatggggataagaactgaaaactcttatcccaccatctttctaatgtcactcttctctgaatggattacattagaaaagaacaaggtgttcaccttctttaatgatgtagttacaaggaatctacctctgggagagacagttatgttttcataaatcctaaggcaaaacattagatatgaattctttttatttttatattttctttttctttttcaattctatctatctatctatctatctatctatctatctatctatctatctaatctatctgtctatctatctatctatctatctaatctatctatctatctatctatctatctatctatctatctatctatctatctatctatctatctagtagagacagggtcttactgtgttgcccaggctggtctcaaactcctgggctcaagtgatcctcccacctcagcctcacaaaatgctgccaccatgctcagccagatatgagttctttttctaaaggaagggtttatttaaaaggagtcatagaccatcactggattctagtttcctgagagacatagagggtactctggcattgaagagagacactagaaggatggacatttttggaatgtttaacaagtctctcactttacagcatcagcagcagagagtgttaagcttgaaaaaataagaaaaaagtataaaattatgatcttagtgaattaatgacatattgccaagacttaggccatcatttatatattaacattaatgggatgtgaatgtttataataaaagacaaaaagatgagcttaaagaaattagacctattacccaaacataaatatttacttttacatgttgtcagagagtatttgtacctgtcatattgctgttttgcaaattagagagttaaattgactcctttttatagatattctatttccgtcctaaaactctttccatcactaaatctctcactaaactttgtggtgttacataatcctcactttctagttagtggcaatcataaaaacagataaaaaggctttcattattaggagtggcatggatgaagtagttgatactattggcaagatagaacatgacaaagagagcatgaccattatgacttatgcattaagtgaggtgttttgggctctttctggctatgcaccatatggtaaggaaatgatatctctgtcaggatagactagattgtaatgcagtaacaaatgaccctacttaaaaaaaattattgttatttgaatatttgcaaaatttaaggatcatgacatcatgatgaacatctatagaaatacatagctctctacctaagtacaaaatagagatatagagataaagtacaactgattcagatagttaaattattatgctattatttaatgttctcatgtgcagttttatgtattccagataatctttctaaataacttatgtagacatttatattttggtcagtctatttttttatttccaagtaatttaatttttgtcccaattgaattttaagaatagagctaaattaaaactgttactcagagctttttattcacttttatgttaataaagggttccttagagatgatatacctagttttctgtaagtggtttttattttcttggtaatctacaagtcagattttaggcaacacctgttgaaaaaaggttagggcaccatttacatgtttttcaaattgtaaagttctaatgcaggtttctgcagttagaatattcatgacacaaactgtttcaaatacaacttaaattgagattcaggtttaaatgttgatttatgaaagttcttctttaatgaaacttgtttttatgagatctctgaattgcaagaagtaggacttcagctttggaactgaaatagctcttggctatttgttttaatcactttccacacaaacctcacttctgaacggtcatcttatttagagttattatcaacttacttgccttagtgctgacattgttgatggattcgaagaagtgaaattggcaatcctgtatctaatgctagtgtctttggaacaacaaaaggagtttcaaagggaggctgaaattgaacacttaatattataaatcatgatatatgtatttttttgttttgtcttgtcttttactttggagaggggtttctttactgcatggacagttgtattcattaaatatatagaaaggtcatggctttcctaaaactttgggctgttctttaaaaattaatcttattctcatcaggagtttgtcacttctaaactgatctgagttaatttattggaactgtgagtaagagacattacataatttgggcacaaggagagaatctgtgtcctggaacttgctgatggcaccttcaaaggtgacccagttgaccagaaagtgttgatttccactttgtaattttaaaaatatatgacaatcaaagggcatttcatgacccaggagggagtggaagtagcaaataagcatgattattgcaaaagcttactagattgagtagaaggaatatgcactgctgtcaaaaagttgcaatgtaaaatagtcaaaactttttctatggctctgatgatagcaatcaacaaaatgaggaaaatgatgtggcaggattcagaatctgactaaggagtactaacagagaaaattatcatgttcttggctttagagacaaataaatgggccatgtgggcccaatcttttgtaacttaaaaaatgggaaaagctacgggagagttaacgttaccattttatgccttaagtgagatgttttgggctctttctggctacaaggtttggaaccacaattggattaatggtagttggctttaatggtccgtgggaagctaaaggttacaggcaatcatttcatcagcctcctggctggcctcaatggaaataaaattgtcagactgtaactttaaggaggctgagttagcaaatatattaatttcctattgttgttgttataaattattacaaatttagtggcttaaaacaacacaaatatattatgtcacggttctataagtcagaagttcaccatgggtctcactgggctaaatcaaggtatccacaggaggctgcaggaaacacgtttctttgccttttcaggcttctagaaactccgtgcattccttggctcatggcccctttttccatcttccaagtagcagtatagcattaccacaactacttcactgactctgcttctgtggtcatactgccttctctcgtctgtaacctgaccctcatgcatccctcttttcatttactgaaaaagcaatgactgtgacatgactaaataaagaaaatttatcatatttcttaaaataatgtatcaaaataattgtatttatcaaaatgacagcaaattaaaaatttaaaaagaaaacagataacaaatcaatacgcagggtatgaaattactccagatgaaatgaatggacaagtgattagaaaataattatattcatggttgctcaagatataaagagatagcagttactaaaaaaaaaaaacacaaacatttagagtcgctaaaaatctcaaaagaacacaactagtgagtgtgtaaaagaaattctagtcaatatgtataaaacaaaagatcactattcggaatatgcagatacctcttatttattaataatgaacaaatgacctaatagaaaaatggagaaaatatttaagcagataatcaaagcagccaataagcacatgtagtttttcagcttcactgttaatcatgaaaatgtcaattaaatatatatgtactattttctactcaccagattgcgtaaattctaaattgtcagacaattgaaaggttgatgaaaaatggctacaattttgcatattgattaaatctaaaaactaatcacccagaaattaaaacttttggtatttacccttgagaaatactaatacatgtatataaaaagacgtgcacagagatattatttatttttatggttgtttgtggtagggaaaaattaacatcaaaacaaacataaaggccatcaaaatggagtaaataaataaaatgtggtaagacatgtaatgaagaaatactattctgaaattaaatgaaatgcactaaatgtatgtttcaatatgtggggaaattttttgttgttgttttttttttttgagacggagtctcgctctgtcgcccaggctagagtgcagcgtcgcgatttcggctcactgcaagctctgcctcccgggttcacgccattctcctgcctcagcctcccgagtagctgggactacaggcgtccgccaccacacccggctaattttttgtagagacggggtttcaccgtgttagccaggatggtctcgatctcctgacctcgtgatccacccaccttggcctcccaaagtgctgggattacaggtgcgagccaccgcgcccggcccatgtggggaaatttaaaaaagatagtgagtaaatgatatgaaatatttatgtaaactaaagcacagcctttctgtagccagctaggtggtccgcacctataatcccagttatttgggaggctgagaccagaagataacttgagtctaggagtttgaagccaccttgggcaacatagtgaaactccatctcataaaaaaaaaattaaaacacaaaataacactagataatttgattggctacatattcatatgttcagaagtttgaaaactaattgagggataaatagcaaatttctaatagtgtttacaccagtgtagacgaggagtggatcatcaaaggaggtgaggatagaagagagcctggctagatgagtgatatctctaattattttctgtcgaaatatacctgtattcatattttcagtagtttgtgaagtatgcacatggggggaaatgtgtttatgagtaaactaaataaagtataaaaagtggttaattctggaagctagcaatataggttattaatattatttcttttttatgtgttttctaagtttgtaaatattttatcaggataattataccaaaaaaagtagttttaaaaaacagtgcagcagattaacttcagaacatacagagccactgggcaaattcctgagcagaggaatttatatcaaaagcaggatacagaggcaaagagatcttaaaaagacagttaagagatgagtatagcttttgaagctccaacatagatctaactgattattcataagaaattaataaagagaataaaaagaaggaatatttgaattgataatgtcaaataatttttcagaactgaaaaataagagtagagtccactgtttaaaagtatgcattgaatgcccagtatgataagtaaaaataaatccacctatagaaatcaaggttaatgagaacatcttattagataccagaaagaaaagacagactacctacaaaaaaaaaaagacaattagaatgacaccaagcttctcgttagcaaggagagatgccagaaaacaactgaggataaaatatttcaaccttaaattctatgcctacctaaacaattgttaagaagacaaaataaataaattttctgatgttgactaactaagacaacttctgtccataaatttagtggagaggaaggttttttaaagcaccagcaaatgtgaaaccaaaagacaaaaataggattcatgtaacaatgcattttttcttcctcctctcgaaaagaagttaaaacttctatattacagtcaattgaatttccagtaattttccttttgagaacaaataaagtaaggaaaatctttacattttgcctcctgtttcttgataaaatgttaggaaaagtcaaaataagtcgaatatttgatgaaattgatgcagttcatgtcagtatgcagtaattggaagccttggaaccctatgtaggctgacatagaaagcaatgtaaaaatggcacgtgaattttctttcttctttctaaaaagaagagctagatttttagataggaatacaaatgcttcatttgttcataggttatcaagattttctttcatttgaagttttgtttggcagacatcttcctttgaaaatgggagacttgtggaggtttcaaagggacttgtgaggaaaaagttttggacagaaccagaaactggctggattgagagacaacatttttatacaaatgcacattgaaagggaatgaaataacccttaattccaacatgatctgtttcagattactaaaggaaatatattatattgtatggtatataatgagcactcaacaattttatgttgaactagtagcaattatcttgtgctcccgacccactaagcttatttaaagatcaagaataacagattattcttgatttaaagatcaagaataacagattattcttgatttaaagatcaagaataacagattattcttgatttaaagatcaagaataacagattattcttgatttaaagatcaagaataacagattattcttgatttaaagatcaagaataacagattattcttgatttaaagatcaagaataacagattattcattagattatttatgtactagataattaattcagtttaatataagaataatgaaatagattaaaagagagccatgcatgggttaatgatattaaaatgtcacaaacgaataattataccaattgtgtacacaggagctttttgagaaaaaagtagcggattttatgttctgttgaaaactgtaaagttctatataaatgttatttcaacagcattgaaatggtgattttctgagaaaattttctgtactagtttaactaaattatacatggagatcaaatgaattctcaagtgggcctatttattttgaatcaggaattatataaaatatggaggacattattaagaaaaatagcatttaagactaggcctaattaatattttcaatgagggtaatttcataggattgaagagagaataggatttttataactgaatatggtataatagagaccaagagttttctggtcattcattaccaagaaaattttaattatgtggaaaaaagcaaaagaacaagaaagtcaagaggatctgaagcagagtatttatccagcccagtgtcacttgattaaaatagagatgttgtagtcctttagaatgtccatagagacaactgaaactgacctttaaaaagtgttgactataggttttgttgttactgagctttgatagccactttaaatcccttctgatgcaatttatgccctcccttctttatcaaaaaggaaaaaaattgtttagtagataatatggaaatatgcctcatttctctacagtctagcaccactgaactagaaaatataaggcatttatattttctagtttggtgatttcgaccattgaagtgttcttcattccacgctttggaatggaaacttgaaaatgatgtaggaatatagtataaacattctgactagagtatgattgaaaaaaatgtaactagagtggttttctcttttctgtagactgttctttcagtgcacctcttaatatgattatggctccaatctcagagagcctgagaaacttgcccaagtccacatggctagaacataacatgattcattcagggtatattaacaataaggtttattttcgggttaagaataagaaaatgccttatattttttgagtgttcgtttaaagtccacagtcaaaaaatattatatgacttcatcaaggcctaactctcttcactttatcacattgcttcaacaatagactgttaaggcagtggaataatctgggatgattaattttcttgtaatcattgaggaccatgaataaaattgcaaaaaaaaaaaacaactgccattttttccatttatatttttaattagaaagcaggcatttaatgagaaaaattcacgtttgccttgcaactacttatggtcgcgttaaaatgtctatcaatgtaggataaatggaaacatgttaagatttgattattaagctttgcttaattaatatatttccaggaaaatatcagactactgatttgggctacaaataacactgcctggttttttgtagccaggtagtgttatttgcagctgaaatcagtaagtttgtaatttagaacctgttagcctaataaatcatcatgtgttactatgaatatgtgaaggcatttaactaaagtctaagtatgatccatcatatggaaatacgtgaaggcatttccagtctttagtaaggacatggcaatgtcactatcatatagaacagtggaatggctattatttgcctcatcagacggatgcattcttaataaaagataaattagattgaacccataagcggatgtcaggaactgtgagatttacattttagaaacatttcctagaaatatcatgggaaaacttatcaaatggatttttattatcaaaaatagctgagaattgttcgtacatctacatatgctcatgttccttaattctaaatttgcttcagaaacaagtcagtaatttaaatgacaaataaaacattggaaaaatattttcaatgcatataagctaatttttattttaataccaatagacattacatgctttcttagaaaaagaactgaatgtgaaaacgaaacagtttaatctctgctctgatatcacgcatttcactggtgagtctactatttttttctcatacattactacttaaaagtatgggagtttgataaattcaacaaaataccttttattgtagccttaggtggcttcctttgttttctcagttaagaagaggacattaatgagtatgaaaacatctaagattgttgctttatttactaaatgctgggctgattaaatagtaagtctgccaaagatcacagccttgaacaaaaggcatagatgcatatcacagagtaccaggaggggattccattcctattccatttgagtctcccctgacaaatgatactgagcactacgttacattgattcacttgcccacaaaaggttgtgataagagtgtctaatctttatgcttgaattgccttattgtacttgtagaaatgaaagcagaagaaaatatatggaaaacagattgtgtatcttatttgtcttctgtccaaaggatacatttaaaataatttgtctagccaggcgcggtggctcacgcctgtaatcccagcactctgggaggccgaggcgggtggatcacgaggtcagcagatcgagaccatcctggctaatacagtgaaaccccgtctctaccaaaaaatacaaaaaattagccagacgtggtggcgggcgcctatagtcccagctactcaggaggctgaggcaggagaatggcgtgaacccaggaggtggagcttgcagtgagccgagatcgcgccactgcattccagcctgggtgacagagtgaagactccgtctcaaaataataataataataataatttgtctaaacagagttctttcttcagtgtgctcttcacattttaatgctgatttgaagcctgtaaccattaaaattaaaatggaaagattatactttaagagtagaatcctcaaatgcatatagaagtataaacctaatgccctttagcaaagtctaggaggcatcaagataagattagttcctagtagttactctttgttaattaactccctgaagaaacctgagaacatttgatattaaagaaaatatagtagttcattttcagatagattgaagttttccttgctcttctaatagatgtcttcctaatatagtttccataatctctaaatatcataccctgcttttattctcttgtatatttcccctcccatatataaagtatataatgtactgagaaacatagaaataattgcaatatacaatattcctagttacatttcagtaattgttttgtggcatacagttacatattctttctgggagagtgtgatgaaggatatagatgaaagattggtcatttcagtgccaaatcatcttagactttatgtcccttcctccctacaatgtcaccatcctctgtaacgcttttctcagaattgagactccctgaaggtcttagagtttaacgatgccctttttgtccattagtttatttaataaatgattattgagcaactatatggcaagtactgttcttgattgtaaaatctggcaaggacctttaaggtcctcccagggtcttttatcttataagttgtcaaaaaggcttagtagtaattattttatttgagttcacataaggatattacaaggttaagacttttatcgtgacaaaagtttttgtgttttatttttcgtgtctctagttatttttgtttcatttttattctcaaaccagttttgaatcaagggattttatttttgtccagcatttcactttaagacagttagagtttcttacaattcctgtgctcatgaatgaaaattaaagcatataatcattcaactaaagcgtattgcttgtcatcttaaaacctattttaggatgtgaagtattatttattgaaattttaagttagcagtgtttgacgtagtttgtatcagatactctccaaagtcattttctgattaatggagaccatttaaatatataaataactgatacagaatgaatagcactggctattacaatttctttgtctttaaattcacaggagaatggtgttgcctaagaattgttggcattttttaatgaaaatttgtttatacatttacataataaaattaaaaccctttttcaaaggcacttgacatttagaggcattgtttaaaaatattttccagcatcttctagattttacaccaagtgaatgttctgtttaaaaatggttctatggtcaaacaagtttatggaatgatgcctgcttattctccctgtagaaattcataatgcccatttctgtatcagaaaaatcttagagaatcttgcttatctttatgtttccctttagaaaatgaaaactatttcaaacattttattagtatgtagaaaatactatgacagcagaagtattttatcagtctttaaatttttcccaaatagcaatacattccagttgcatgcaaatgtaaataccttctctcaattgcctgaaattaatacattaaaataacagaaaaatagtgttatcttagtctgtttgggctgctataacaaaatactttagacttgtaatttacaaacaataggaatttatttctcacagttctagatgctgggaagtccaagatcaaggcaccagcaatatcagtgtctggtgagagctctctgcttcatagatggtggcttgttgctgtgtcctcacatcatggaaggacaaacaaactctctcaggcttcctttataagggcattaatcccattcaggagggttccaccctcatgatatagtcacttcacaaaggccccacctattaatacatttgggattgcatttcaacatataaatcattgagggacacaacattcagaccataacaagaataagcttggatttggaaagaatttgaaaaggaaagtaggaatacaattgactttcccaagttcataggtagtaacaaagaatgagcaataatcaagatgcctttgttcttatctttccccaactcaaataagttatatataaaaattcatttcttactaggtccattatacttgtctatctcttgaaaacttgagtgtcctaatgaaatgagacttctattttgtaagatgagagaaaggtgaggcaaatattctgaggcaccttctagactgcagagcaacatgcactgagttttttgaaagatttaccagttttaaaaaataaatgctgtcttgttcttcatcatcctcccatcactggcatatcttggtaaaagtgagatgttatcagtgagagccctttaggtagatcctcgtaaaagttaccattttgagaattgtatttatgattgttggtgtgttaacaaaatcatgttgcaagagaaatggacttttggctaactgcctagctctattatcctagaaactagttaaatggtatatgtcaactattttatgataaaaatgtcccccgtggatggatgagatgtatctaggttggaagaaccataaatacttgagaagaagtcacagctttgggtgttcctaggtgcagggactcttgatatggggcatatcccttgaaggtctttggaagctgtattagtccattctcacattgctataaagaactacctgagactgggtaatttataaagaaaagagatttaattgtctcatggttccacagactgtacaggaaacatggctggggaggcctcaggaaacttataatcatggtagaaggcgaaggggaaagcaaacatgtcctatgtggctggagcaggaggaagagagcaaagagcgaggtgctacacaaccagatctcctgagaacttactcactatcatgagaacagcaaggggaaaatctgcctccatgatcatgtctaaattgcatgtcagattgtaattcccaggcccttcctccaatactgggaattacaatttgacatgcaatttagacagtgacacaaatccaaaccataactttccgtccctggcccctcccaaatctcatgtccttctcacatggcaaaatacaagtatcccttctcaacagtcccccaagtcttaacttattccagcattaactcaaaagtccgcagtctgaagtctcatgtgagacaaggcgagtcccttctacctatgagcctgtaaaataaaaaacaagttagttaattccaagatacaatatgtcttggctattagcattcggctcctctttacttatgcaaatctctgcagccagcttgagtactccccagaaaacaggtttttcttttctaccacatgatcaggctgcaacttctccaaacttttaccctctgctacccttttaaatataagttccagtttcagatcatccctttgctcatgcatatgctgttagaagcagccaggcaacatcttgaatgctttgctgcttagaaatttcttccaccagatactctaaatcgtctctctcaagttcaaagttccacagatccctagagcaggggcacagtgctgacagtctctttgctgaagcataacaagagtgacctttgctccagttcccaataagttcctcatcttcatctgagaccacctcagcctgggtttcattgtccatatcactatcagcattttggtcacaacaatttaacaagtctctagaaagttccaatctttccctcagcttcccatcttcttctgagccctccaactgttccaccctctgtccattaaccagtcccgaagctgcttccaccttttcaggtatctttatagcaatgtcccatttcccagtaccacttttctgtattaatcagggttctccagagggacagaactaataggatatgtgtatatatcagaggaagtttattagggagaactggctcacatgaacccaagtcaaagtccccaaaagtctccaagctgggaaaacaaggaaatagtagtggctcagtccgagtccaaaaacctcaaaagcggggaagccagcagtgcagccttcagtctgtggctgaagggctgacagcccccagcaaatcactggtgtatgtccaagagcccaaaggccaaagaacctggagtctgatgtccaagggcagaagactccacaagccagcttatcccaccttcttctgcctgctttgttctagctgcactggcagccagttggatggtgcccacccacattgagggtggatctttctctcctattccactgactaaaatgtcaatctcctctggcaacaccctcacagacacactcagaaacaataccagctagctaggcattctgcaatccaatcaagttgccacctaatattaaccactacagaagctgtcagtggtgttgtcctgaatgacgttggcctgtacctgttagggtgatagctcttctaaatcagaacaatttccccatctcaataatgtggatctgtttccttgaacctaaactgtgtctctgagggtatagcttccagagggctgtgtgagctgtcatacacatgaaatgcagcaaggactcttatggagaggacctctatcacctgacgtagtttctgagaagactcatggcaacagcgcctatcatagttttgagtgtctgaatgtttaattaaatctacagtgaccccttggagggtgattgaatgatatttctctactctccaaatatgcaacttcgttcttaccctctgcatcatcatttataaaatagaaagactagagctggttttctccaggtgtggatctctgataatcctcagcagagtcacttgggatacagattctcaggtctcaaccaagagaaattaaatcaggatctttgaggttagggtcctgtaatcttcttttttaacaccttctcctccccatggtacttgaatacacagctggacaagatgctcattagtttattttctattttagcccttgaccttataattctaatgatttgttcctcccattctacataatgtcttaatgcaattcaaatctcatttcttcagaagaccatcaaggaataaataactgggagtttcagaaatggcaacagtttagggaaaatctctgtagttaagtcaggtttgagaaacccctggaacaatttgttgtaattgtatacttttttaaagatccttttggtcccctgtaatccttatgattattaaaacatacaggtccttagcaccatataacgattctgtttaaactgttggcttttcttttttttcaacatgctatcaccattgtcactgttgccttgactgtagggtagtgacttgctagaaggtcagagattatattaggtcttaccaaacaagtgaaaatcaatattttcactctctttaggagaatgagtttcatatatactcgagatgaaagaaaaattccctttgttgttctgctgaagttgtcaagccttccattagtctaggttaagtttctggggttatgaatttaattttggtttctaatattgatttatatttcataaagactttgttggttacaaaaaaaaaatcctcagtaaatttttctacttcaagggcagtgctttagtttagaaaaagatgtgtttctcagtgatttagtttccatttctggacttaacaataatgagtgaaacaggaaattttgctgtgaattatgaaaggttattatacagtatttccaagccactcaaaattatgcattcatcttaggctcttaaatttaacaaaactgaatgagattcaatactattttctctgttttatcaaaatgttattgaaagttgtttaagattttatactcctcgagggcacatatcttttgtcatctttgcattttcagtagtgtttttatactgcagataatttatgcacattttataaatgagtgaacaaatagatgttatgaaaaaaaagtactgttatcagattccaggataaagtaaaaagcaatatttagcaatcctccatatactacaatgccctacccaagcctgttaattccactcctcatcctcatcctgccacaaacattttcagaagtcctcagacatctctgctatattccctaacttgccccaaactcccgtgatccaaaagtaggcttccctttctcaattaaacttccctttcgctcagtaccccaatctgagcttgctatcctgcggagagttacctgggaaatgaagagatgcagctgtatgatatatatgaacaagtttacccttactggggagatttgtattttaaaagatggtgatggaaaactacagtgatatatacatgctaacttttcccaatgttcaaatttcaggtagtgggacatatggcaaaggtatttttcaatagcaacctaaagacctctcagggaggtgacctccttttctgcctccaagtattgctggttctgctataacctgatatgattttttatttatagagtgctttttataagttgccttcttcaggaaacataaaagagtgggaggggaaatgaataatctctcatgcttttgtatcagttattatcaactttggctgtacattagaatcacctggggagctttaaaaaaatccttgtgtccaggccatcctccaagccaattaaatcagaatctccagggatggagcccaggtatcagtatatataaagttcccaggtaattagattgtgaggcccactaatctaaatgaggatgaggaatgcagtagatctctgatgcttacagaagacaatagttataagaaaaagccatgtgagaaaaattggaaatggttgaccctttgggaactggagagcaaagacagtggctactgagctccaaccaagtgttgcaccatgggagggaaggagcaagatgattaagaggatcagccctagtggcagatcccctgaggttaaagtacttttctgcccttcactatgtgagtttgaatgagtgtcttctttgtacttgttttcttattagcaaagtgaggatgatgattatacctatctcttaaggttgttgtgaggattaaatgaaatcataagcataaatcacttagcattatgttgggcacgtaacaaacatattctacacttttgaactattttgttatgatgatcaactttgaaatactagagttcacttgtcttcttttcagtaggaagttggcttccaatctagggagagagaaggaagagaagcaagagctagggagatgataatcaaatggttctgagaatgatcttaaatttttaagatttttaaatttttaaaaaggctttctatccccttgttcccaccctcagccctcaagaatttcttactgtctttatttcctgccatttcttgttcttttataatcttgtacctctagtttcactatacatcaaaaagatgggaagtgatatgctaacataaatgggtgaatttgtagatgtatcagttgagattttgctgtgtagtaaactacctcagaacaaacaataattattttgtagcttaaaacaactattttgtttgtgcctcattaatgaatgggcaatttgggctgtgttctgctgggtggttgtttttatggccttactcatgtatcagtgtcagctgttggtcatcagggacactctttatttcaggatggactggctgaggctgggatgaaggggttgactgagccatgtgtccctcattatataactagttaaccttggcttatttacatgatggaaacagtttccaggagtggaagattggaagcttttaagatcaaggctgataaccagcactgcatacttctcccaatttcttttgggcataaaaaatcataaggctagcgcatatccaagggaaaagtaagatgagagttgcttcaaagcgttatggccattttttggtaatctttgacaataacctgttgaaataaagcaaatgggaggaaatgaggtcacagtgaggctgatagcattggacatataaaagtcatattatagataggctttggcagatgactgggtatgtgtggtgagagatagaaaaaaattagtggaagttgcagacttagtaattatgagaattgaactttgattaactaaaataggaaagccagaaggtgacaaagtagcacggaggcttacctatatattctcttacagaaaactttgtactgtattccttttctaaaattgcttttgttttttaataaccattttttcccaagggcaagatgtgttttaaaattcattagttaaggactcaaatgaccaattcgatttttctacttcttagttgactccttcatgaacttttggaataataataaaatgtataaatagtgtatgtactttatgctttaaatgaatattcctctaatatcaactccaaagcaggttattcaaagtatgaaaaccaacatatctaactctgtgctcagaccaagatttgtgtagcatctctagagaatctgagagaaatctatgagaataaaagacagtggcactgagacattatctttacatatgtgcttattgaatctgtatagaattcttctataaaaattatagacttttttgttacagatttgctctcatgaatttaattttatattgccttactcttatattgtcactttatataggccactagactgtgaaataaaatcagataaaggtagatgttttccaccactaccccttctccccaatttagtattcacaattattttgctatagcaagatggtctctcctttttactggtattttccctcagaaagtcttttttttttttttcactttgacgtgcattacgttaggtactttaaaaatagcatattttcctaaattaatagtctttaatattcatttataaatacccagcaccacttaacctagtgctttaaaaattgattattatttattattgccattacttaaaatgtgcttttaaataattaaatgactttttaatattcccctctctctctcactaacttgaatacattttaccagccttgatttgtggagatgtctccacatggatagctagctctactggacaggatagcttgtgttactagctcaggcataaataattatttacttttgttctcttacagtattttcctgatctgttactttgctacttccatattattgctgcataataaactatctaagtactcagtggtttccaataacaatccttaattctcactccgttatccgtggatcttctgggggttggctatctgtaaggggcttagctgagttagactctaagatgtaggttgagtctcggtctgtgtcatataactcattctctttaaacccatcataggtttgaacatggtatggtctaggaagatgactctgacagcactttttctctttgccaatttgaacgcagatgactagacatctcaatgtataagatgtgaaacaggaaacaacatgcaaatatacctttattgacttataacagatgacagcaattccattttcctctactattgcattttctactctatttgtgaatgtgagctttcctcatcaatttatagaatctctgtatgactcattctgtcttaatctaaaactgaaataactttatattgtggaaataaaatatcttacatctcaatgtagtctaaaataggttaaatgagatggttcttcctgagcaagcacagcaggtctgcaatacatcttctttctccacatacattatgtcaagtattcctttagcatttatataagttgtatatgtcacacagatatggatctataaatgcaaacagagcacagatgctggcacgatacacacttaaaattgttttatagcttttggattttatttgtgtcgacttaaaagcaaatttataaatattttttatttaagtaaaagatgtgagctgctattaacactgaaagtgattttagagatcatatattctacctcccacattcgtcacattagggagtacaattcagatgtgtcaagtggcttatcagaggttggactgtgagttagtagaagacctggaaatgaactccagctctcctgactacccagttggctttttccatcctattgccatatctcctaggcctctgccaggacagagtgccacagaactgtcagatggggaaatgagacacaattgtttcctggattctattattgttgagatttttaaaaatgtgttttaattcctaacctagctttgcaggcacatcaaagctgagtgcatgtccttccgaaatcttccctggtatcctgtaatggacactgattttttttttaaatcttcgaattcttgtaacacttaaacattttggtgtgaggatagtaaaatcattaagaataggaagcatatctcttgctccttctgcaccctctcacagagattagggcagttctggctgtttaatattattgacaactccccagaaagatgaacacaataaactgttgattgagcacagccaagtttactagatcaactacagtaagagagagcaccatctgaatggagtcttggtaatgtgtcaaaatatgatatttttaagagtttcaagcccaggctgtataattttagggttggtcttgcaaaatgggtagttagttgaggcttgggctgagtttatgtcctaacaggtttgaatgggtgagaacaacactacaagaacccatgatatgattagtgatgggtaaggtattccagtatttttagtgcaagacgaggaaagcatgcatcttcccagaattgcttaacgtgggaaaacatagtggtatcagtttttaatatttgcttatggacaggtcattattacataatcctaaaaatgaaactgggtaaaccccaagttatatgtaggaggcatttctaaataacactcagaaattggaaactatgtaattaatcaattaattaattaatttttggtatacaaatatagctctattaaactaatgataaagatagcatctttttttttttatttttttatttttttatttttatttttattttttatttttttttatcatactttaagttttagggtacatgtgcacattgtgcaggttagttacatatgtatacatgtgccatactggtgcgctgcacccactaacgtgtcatctagcattaggtatatctcccaatgctatccctccccgctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacatgtgcatgtgtctttatagcagcatgatttatagtcatttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctatgacaaacccacagccaatatcatactgaatgggcaaaaactggaagcattccctttgaaaactggcacaagacagggatgccctctctcaccgctcctattcaacatagtgttggaagttctggccagggcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaagatagcatcttaaaaggatacattgggcatcagattcaggaactagaggcagaaaatttatgggaaaggattgcaggcactcagaagtaattgtggcacaacaaagtgatctctgtgccatatcatttgtcctacagtgcatgctttctagtttcctttgccttgacttcatagtaacctcctagatagagtctaagattgctcctctggcactggtcccttgcttacttgtgcttggcctgtctgttgctgacttcatctcagacttcagcctacagccctgatccctgccttcagtccatatccttggtttggtaacttgtttatgcggtcttcccagtatgtaaccactgtccatactctgtccatatcactgctccaaggtggcttatggtactatatttccaaaagcctgctaaaggtcatcactacagcaattctcctttttctcccatcatcaattttctcttctctactgaatattcctgaaaacatacgaacagtccattgtttttcccattctaaaagaaagaaaacctttcttgactccaatttccattatatttaactccttattatctcttttccataattgcaatatgcctaaaatttcttcaatttctttaattaatttatctcctcccattcttacctgaatctaccccaatcaggccttcaactccaccgctttgctcaaagtgtactggtgaagttgagtcttgatttccatgttgctaaattcagtagtaattctcagtcttcatcttacttaaaattatccaggctggagtgcagtggcaagatcatggctcactgcagcatggacctcccaggctcaagtgatcctcccacctcagcctcatgaatagctaggattacacatgtgcaccaccatgcttggctggtattttttattttttgttgagatggggtctcactatgttgcccggtctagtcttggctcctggactcaagctatcatcccgccttggcctcccaaagtgttgggattacaggcatgagccatcatacctggcccatcctacttaaaatttcaagaacacttcacacacagctgatcaatctgttctctgtgaaacattttatcctcttagcttccaacataatcacttgcctgtttttccttctaggtatctaaatgctcattctcagatttgtttttcttactggtttctcttaatttcctcatcttcttttttaaactgtattttattgtgttgagaacacttaacatgagatctgccctcttaaaaacttttgaatgtacaatacagtattgttgactataggtacaatgttatacaacagatctttatcttatttaactgaaactttatgcatattgattagtaattcccatttatccccacctctatcccctggaaaccatcattccactctgattctatgaatttggctattttagatacttcatgtaagtggaacaattcattatttgtctttctgtgactggcttattttaattagcataatgtcctcaagtttcattcatgttgccatttattacacaatttccttctttttaaaaggtgtattccattgtatatatgtatcacatcctctttatccattcatctgttaatgcacatttaggttgtttccacatcttgctattgtaaataatgctgcgatgagcttggggtcattgatatactgatttccttttctttgaataaatacccagagttggattactggatcatacggtagttctattttcagtttcttgaggaaccttcaaactgttctccataacagctgtaccattttacattcccactaacagtgtgccagggtcctaatttctccacaaccttgccaacacttgttttctttctctatattaaccatcatgacaggtatgaggtgatgtcatatgtcattttgatatgcattttcctgatgattagtgacattgaacatttttctcacatacctgttggccatttgtatgtcttctttaaacatctgttcaagtctttagcccattttaaaaattagattactagtgtgtttttctgtttgtttgtttgtttgtttgctattgagttgtaggagttccttatgtattttggagattaactctttatcagataaatggcttgtaaatattttattccgtgctataagttgcctcttcattctcttgattgttttttgttgttgttgtcgtgtaggagcttttcaattttaagtagtccctcttgtttatttttggtttggttgcctatgcttttggtgtcatattcatgaagcaattggtaagattaatgcatgaaacttttcccctgtgtgttttcatagtagttttacagtttcaggtcttatatttaagtttttaattcattttgagtttatttttctgtatagtgtaaaacaaggatcccattttatgctttcatatgtggatatctagtttccccaatatcatttgttaaatagactgtcctttctccattgtgtattttcggtactcctgtcaaagatcaattggttgtatatacatggatttatttctgggttctctattctgttagattggcctatatggctgtctttatggcattaccatatcttttgaatactgtagatttgtaatatgttataaaatcaggaagtgtgaaacctctaacattttctttcaagactgatttcatcgtttatggtcttttatggttccatatgaattgtagaattttttttacctatttctgtaaaaatgccatggagattttgatatgaattgcattgaatctatagattgctttgggtagtatgaacgttttaacaatattaattcttccaatccatgaacacggatatctatttgtttgtgccttgcttattttttttaatagatgttttgcccttttcagtgtacaactcttttgcctccttaagtttattcctaagtattttgttgtttttggtgctaatgtaaatgggattattttattaatttcttctttagatattttgtttgttagtatatagaaacacagctaatttttgtgtgctgattttgaatcctgcaactttaccaaattcgtgttgtagcaggtttttggtggaatctttaagattttctttatataaaatgttgtcatttgctaatgggaacagtttttttctttcagatttggatgctttttgtttctttttgttgcctaattactctggccaggactttaaaaccatataatttagtctgcagacatcgttagccatgaaattcacaggtcttatgcaaagctgggactgctgaaagtgccatttgaattttaagaaacaacagaggagtttagtcagttattctttcatgtgttattgaaactcagttttgagtgccatctcaaaactaacagaataaaaagaatgtgggaaaattctgtatgtactcaatctcaactttcctccttgaaagttaatatttagtaaaatgtagtctgaaagaaggaagccactagaagtcatagaaacagagagtagaatggtggttaccaggggttgaggttgtgggcggggggttggggggcattggagtatgttggtcaaagggcacaaaatttcaattagataggaagagtaagtttaaacgatgtattgtataacatggtgactgtagttattaacaatattcttgaaaattgctcagagtagattttaagcattttcaatgcaaaaaataagtttgtgagttaatacatctgttaataacttgattagccattccacaatgtatatgtacttcaaaacatcatgttataactataaatataaacaacttgtatttctccatttaaaaaataataaataactatttatagaaaaggaaaccactgggctcccccttgcactattggtcttatctggggaaactgttagcaaaggcgaaataatatgccagatgttccaaatggatacgtgataccaacaggcttctgttagaaactatctcctgcctacaatccaccaactgcagtagtgcttttgtgtcctgcatgtgtactgtcgaatgccaaattatagctccattttccctcagcttttctctattcaaactattgcaggaagttcacttgtacattttgttttgttttatccacccagtgctactatttggctccaattctaccataagcacagatatatccccatgcactgaaatcttgtggcaatgcttacagtggttaatatttttggattatcttcaaaatgaaagcagcacactatttttaaattgttcttgagaaccctcaagcctcaatttgaaagatactgccctagagacctaacataaacatgattctctttttaacatgcaaacattcattccttcagtaaatatttattcagcacctactatgtgtcaggcattgtactttgcactggagattcaatgggaagcaacaatggataaggctgttgccctatgaatttatggtgtaatggataaggctttccttgaataagtcacaattataatgaaccaggcagctaaggacatgttcacatttttatgtagtatgaacagctgtagtacctcaaattgatagaagctatgagttatatgcaacttaaacttgaagtatttttaccactgaaatagtctagaagctgttcctgagagattaagttgttttgcattatcattaccttgtcatcatcagtggtatgtggatgtcatggttaaaagaggaaatataatttcggaatttgtggcttctcagtagagaacacatttaaggaatgatctctaaactactatactacgatggaagagagagttctaagaagtgaaagaggataacaagaagattattaggaggcaacaaagataggcttggcctctgttgatattttctagtgataagtgcctggggatcatctaggtgaagctctaggcgaatagtcagaagttgttgatgtctggtaagttatattaatgtaaaaccaggcaccagctgatttaaaacatacataattcaatagaacacttctatatgttaatcaataacatcaggtctgatcatttaggctacttgggttctatgttatttggagcaagccgtgctccagatcctacgagacaggtacactgaggatacctagcagagtccagctctgctactcctatggtccttgaatcatcctgatggacataattggtaggcatgttaagagtgccgaatcttaggccacatttatactaagtcagaacctgtattataacaagatccccaggtatttggaagaaccttaattaaagtttgagaagcacagatctagtaaactgactctctcttagatctactgataatgcattttccaagccattgattctcatatcaattttacctttttaactcattttatagcattctctgggcttatcatttttccctcattcaacatcactttttaagatccttcattcatactttcatgcattcaatgtattcatagttagcgagcatcttctatgtgtcagtcactgctctaggtgctagggatagaggagtaatccaaacaggccatatccctgactttatgaagattttagattatcatattttccatggcactcctattttcaggtattctttatgatctcagatcattgctcttgatttttggtataaaatgttatgtagcatgacagaataaagttgattatactgagattgaaggaacagaatgctttgagtcatcacagacttttgttacagtcctggatatactatagcctactagctatgtggtcttgggaaagttacttaatctcttcgactcaatttcctaaactgtgctattatatattaattagtaggataaaataaaataatatatattaaatgtctagtaggatatgtggcctaagagactttcaataaattggaggaagaacaactctggctgttcttgtattgctataaagaaacaacagaccaactaatttctaaagaaaagaggtttaattggctcacagttctgcgggctttacaggaggcatggtgctggcatctgctcggcttctggggaagcctcatgaagttcacaatcggcgcagaaggtgaagggggagcggacacgtcacatggcttatgattaacgtatagaagctttctattgaattatgtatgttttcactcagctggtgcctggttttacattaatataacttaccgggcatcaacaacttctgagcaaggagcaagagcaggaacgagagagagagagggaggtgctacctgcctttaaacagatctcacgagaactaactcactatcgcaaggacagcagcaaggggatggtgctgaaccatttgtgataaatccactcccatgagccagtcacctcccaccaggcccactttccaataccagtgattataattcaccatgatatttgggtggggagaaatatataagctacatcagagcttatacaagaaacagcatgaacttgcttggggccagtttattaaatccaatgaagctctattagatacaataaaattagacactttagaaatgtacaaaaggcctaaatttgggtagtctcatgccttcccaagggcaggtattttccctcttcctccctgcctctcccgagtgattccttgcacacgtggaagggagatctggcaggatgctgaactagcctgacgctatgctggtcatggcctccatgtttcctgtgaaacccacaagaatagttgagcacaattcttaataggatggcagtgtctcttgctgacccgcccatgctccttgactctgcagagggcttgtaacaggggctcatccaaggtcaacctcaaaactccacctcagacatcaaatggagtctgaaagagcccaaggaagcctggctccttatagaagtcacagtgatcattggagttgatgactgcataaactataaggtgaccacctgacgacagagtagcactaacctgacatcattaactcacctaccacagcttctctggcctcgaaggaatttttctgcagtactgtgctgtgaagtattcaggaattatgttttgtgctgtaacgtgccatagccataaaccaaaataaagtttttaaaaatgagatagctacttaactaacctgttaagatttaggctaatgattagttctctggcattacacatcctcgaggcatgcaccgtagggtaaaggacaccagaatatgagatatcagtggtctggacaaacagatacttttacttcagagcagtgggaggggagatggaagtgttagtaccatcctgtgatcacataaaggtgactcttcacctgcagttgctagggagaggcttgtttgttactcaaatgaacaggaaattaagagatgagcttagttaatgctaggaatgcttcatggctctctataagtaagcacaaacttgtggggtaggcattgtgacaacgaggtgcctgtaaatatgaagttcagtgcacatgatgtggcaaaaaagacttctgcgattcagacaagcacttcttccaaagagctctaagcacaaccctgacgctgtttccttcattctcaggacacttctgtgaattagccaaaggtcaaacccagtccttctgcttagacagaggtagagggagagcaagtcaccagtcgggaggagcagagggggcaccatagtggggactgcctggctcgtccctctgcccttgtcttcttcctctgccgggcactctcctgtctctccacagggctgagcaggatgtggttctcacagccagtggcctaagtgcccagcagtcaccggagaaccaggcccactgaaccttgggggaagccctctgctgttagggaaggagacagatgcagctgtttattaagggtgaccctgtgcatccactgtgcggagcagcaatttgcaggcccaagtggactcaatctttgggaaaacacagagctagatggattcttattactgccatttcacacaggaagaaacctgctcacagggagtaagtgaaggtccaggatcacatggccagaaagtggtgaacagggatctccaacccaaatcctctgacctgctattgaatctggctgggcagcctctggccagctgtctatgaaaggctggcaggcagcagagtgtggccctagaggatctgatgaacgggtgaaaacctaaaatggggaaactcacacaggatgggttcattttctacaatgcttcaggtgacaccatttttctaagttttaacttaacaaagaacatgagagtgttaataagaattgtatgttcttgggtacatcacgtgggacagaatttacatagaatatatatatatatctttcaaaacatatattcagccattgataactctgttgctttattaaatattatgattcttagattagttgtatcatctgtgaatgagattgataattgtgtttgcaataagatatattcataaattccattcattaataataaccattaagaactgcttgaatttcatgtcttagaccatatagtagcttatatgtaatattatcatttaattcaccagtgtccacagagaggacagagcaacacatgtcacaggaagaatcacaacactatttgataatccctgtcttgggttcttttttggaatgaggtggggtatatataaataaatagtaaatgaagtcaacatgaccatgcttttgtatatttctttctggtttacctcgtttcacctctcttttcatatgaaagttcttgctccattaagttcatatcaactgcaatgccacattctctttcccattgccatcaccttctgacctttagaagttccctatatgaataatgccttcagcacttttgtcatcgttttcagcttcaccccaactgccagcatgattctgagattttatggtgccgagaggagcccccctcaccaatgtcctggcctcacaggccttgatttcctcagagccagtgaggcagtcctctctccccttcctcctcagccagctccttgcaccaggcccacagtttacactgtcactgtaagaaattgctggccttctctgaatctctggtttaaccatcccatgctgatgccaccttctatccctctttcaaggtctctggaggatagtgttcctcctgcagaaggtgatccacgctgcttacagggaacttcacttctgttcttgcagagtgggaaacaagtcagttttgcatacccgttggagctccaacagttcttttccccagccatggtgtttgctaggttttgctcagatgggccctgcttggttgtcgtattagcctgagtgtctaaggacaccagtgttcattcctccctcctcctccactttatcccattctccagcccctcgttagtcaggcttcatgactcctaaactttgtgatgtcattggtgacactgggctctgatcagatcttggcatatggttcctaccaggttcgtggtggaaacctgattaccctaatggccgaatccacttttagaaggaagccttgactttctacattgtaggaaagtaaatgagggtttcagtggaaaactttgccttgtatagagtacatcactctaggttctctgacactaaccttgcatttgtctttgagctcatttctatcattttgtaagttgtaggtcactgacagacatgcttaatatctcgtacagtggaggttcagttgtatctcctttcatgttataataaaaccagttttgcctccatttacacgttcatttcaatatccttgatcaatattctagtatgtattctttatattcttttttgaaccagccacaatttctactcatttactcattagttaaatagactctttaaatacatgttcatttcatatctgtatgagtatcatgattttactctgtttgaaaaatatttttaactgttttggaagtcccagtgagatgcccaatgtattcgcttgccagatccagattatctttaatgacaagaaattgcacctcctatgtggttaaaacccaaatgtgtcttttcttggccctctttaggtgaatccaaagcaatgagagaacattgttcactctctatttttctagctttaatttccctctctactaattttgtgtttctctttggttttgtttcatttacagccaataagttattctcctttgttggcagcaatcgttgtgaacttgattttagggtctgacgatttggagatccctctaagtagataaatggtgtatagaaatctaatgactgttgagtgaaagagaacagagaatctggcttatctttctttttgtctgtcttttttaaatctcaaatcagtgaagaattccatgtcctcttacaggaaaacagctcttctatctagactggggagtttttctgtttctgtgttgaattttgacccatgtctgaacaagaatcgaagctataagttgtacttctctgtgcctgtagggataccttcacctttgattgtgtgaatgtattgtgtttcttagttccatgtggtaataatatatattataaagtctctcaaattaaaggagccctgttctgattggtatatctgaatacttgcttatataaataaaaattgcctaaaattctctgaaataaatgaaattgaactaatactttaaatgtgctagaatacaatatatatattcttcatgaaaccattcagaaccataataaaaaatttaactacacataatttaaataaatatttggcaaaaatgaatggtttactttagaatttattaaaaacagctatatcttttttgatgtcagtgttattacaaaagtgtgttttttaatgagttggggattttttatttgtatttatttatttacttttaatttattttttatttcaataggtttttaaggaacaagtggtgtttggttacatgaataagttcttagtggtgatttctgagattttgatgcacccatcacctgagcagtgtacgctgtacccaatgtgtagtcttttatccctcaccaacccccaccctttcctcccagtccctaaactccaatgtatcattcttatgcctttgtgtccttatagcttagctccaacttatgagtgcaaacatgcgatgtttgattttccattcccaggttacttcacttagaataacagtctccagttccacccaggttgctgcaaatgtcattatttcattgttctttatggctgagtagtattccatcgtatatatacaccacatttttcttttccactcattgattgatgaacatttacatttgggctgattccataattttgcaattgcaaattgtgctgctataaacatggtgtgcaagtatcttttttgtataatgacttcttttcctctgggtagatacctagtagtgggattgctggatcaaatggtagatctacttttagttctttaaggaatgtccacacagttttccatagtggtcgtactagtttatattcccaccagcagtgttacagtgttccctttatactacatccatgctaacatctattattttttgatttttttgattatggccattcttacaggagtgagatggtatcacattgtggttttgatttgcatttccctgataattagtgatgttgagcatttttccgtatgcttgttggccatttatatatcttctttggagagttgtctgtttgtgtccttagcccactttttgatgggattgtttgttttttcttgctaatttgtttgagttctttgtagattctagatattagtcctttgtttcatgtaaggttgtgaagattttctcccactctgtggattttctgttaattctgattatttcttttgctgtgcagaagctttttacttaaattaagtcccatctatttatctttgtttttgttgcatttgcttttgggttcttggtcatgaagtctttgcctaagccaacatctagaagggtttttttcaacgttatcttctagaatctttggttttaggtcttagatttaagtctttgatccatcatgagttgatttttgtataagctgaaagatgaggatccagtttcattcttctgtgtgtagcttgccaattatcccagcaccatttgttaaatagggtgtcctttccccagtttataaaagtttttgtttgttttgtcaaaaatctaagtatttgggtgtgtttctgggttctctattctgttccattggtctatgtgcctatttttataccagtaccatgctgttttggtgactatggccttatagtatagtttgaaatcgggtagtgtgatgcctccagatttgttctttttgcttagtcttgctttggctatgcaggttctttttttggttccatatgaattttaggacggcttttctagttctgtgaagaatggtgttggaattttgatggaaattgcattgaatttgtagtttgcttttggcagtatggtcattttcacaatattgattctactcatccatgagcatagtatgtgtttctatttgtttgtatcatctatgatttctttcagcagcgttttgtatttcatttttagaggtctttcttgtcctcggttaggtatattcctaagtatttgattattttttgcagcttttgtgaaagtggttgggatcttgatttgattctcagcttggtcactgtcggtgtatatagcagagctactgatttgtgtacattaatttgtatcctgcaactttgctgaattcatttaccaattctaggagctttttggatgagtctttaggattttctaagtatacaatcctatcatcagcaagcagtgacagtttgacttctgtttactgattgggatgccctttatttctttctcttgtctgattgcgctggctgggacttccagtattatgttgaatagaagtggtgagagtgggtatccttatcgtgttccagctcttgtgcagaatgctttcaacttttccctgctcagtattatgttggctgtagctttgctatagattgcttttattaccttaaagtatgttctttctatgctgattttgctgagagttttaataataaagggatgatggattttgttaaatgctttttctgcctctattgagatgatcatgtgatttttgtttttaattctgtttatgtgttatatcacatttattgagttgtggatgttaaaccattcctgcattcttggtatgaaacccacttgataatggtggcttatctttttgatatgctgttagaattggttagctactattttgttgaggatttttttttttttttttttttgagactgagttttgctcttgttgcccaggctggagtgcaatggcgcgatatcggctcactgcaacctctgcctcccaggttcaatcgattctcctgcctcagcctcccgagtagctgggattacaggcatgtgccaccacacctggctaattttgtatttttagtagagacggggtttctccatgttggtcagggtggtctcaaactcccagcctcaggtgatccacccgcctcggcctctcaaagtgctgggattacaggcatgagccaccacgcccggccttgttgaggatttttgcatctatgtttatcacggatactggcttgtagttttctttttttgttatgtccttctctggttttggtattagggtgatactgacttcatagaatgatttagggaggattccctctttctctgtcctgtggaatagtgtcgataggattggtattcattcttctttgatataattcagctgtgagtccatctggtcctggactttcattgtttgcagttcttaagttacatttcaatctcactgcttgttattgatctgtttggagtttctttatctttctggtttaatctaggagggtttcaaagaatttatccgtctcatctagattttctagtttatgcacgtaaaggtgttcatagtagccttgaataatcttctgtatttctgtggtatcagtagtaatacctcatgttttgtttctaattgagcttatttgcatcttccttcttcttttcgtggttagttttgttaatggtctgtcagctttatttatcttttcaaagaaccagatttttgtttcatttatcttttgtaattttttgtttctgtttcatttatttctgctctgatctttattgtttcttttcttctgctgggtttgggtttggattgttcttgcttctccagttccttgaggtgtgaccttagattgtctgtttgtgctctcgcaaaccttttgaggcaggcatttaatattatgaactttcctgttagcaccgcttttgctgtagcccagaggttttgataggttgtgtcactattaccgttcagttcaaataattttaaaattttcatcttgatttcgttgttaacccaatgaccattcagaagcagcttatttaacttccatgtatttgcatggttttgagggatccttttggagtcgatttccaattttattccactgtagtctgagagagtactttatataattttggttttcttaaatttactgagacttgttttgtggcctattatgtggtctatcttggagaatgttccatgtgctgatgaatagaaagtatattctgcagttgctgggtagaatgttctgtaaatatcttttaagtccatttgttctaggttatagtttaagtccattttttatttggtgactttctgtcttggtgatctgtccagcgctgtcagtggattattaaagtcacccactattatggtgttgtcatgtatctcatttcttaggtctactagtaatcgttttataaacttgggagctccagtcttaggtgcatatatatttaagattatgatgttttcctgttggactagtacttttagcattatataatgtccctctttgtgttttttaactgttgttgcttcaaagtttgttttgtctgatataagaatagctacccgtactcctcacttttgctgtccatttgcatggaatatctttttcctcccctttaccttaagattatgtgaatccttatgtgtcaggtgaatctcctaaagacagcaaaaacttggttggtgaattgttttccattctgctcttatgtatcttttaaagtggagttttgaggtcatttacattcaaagttagtattgaggtgtgaagtactattctattcattgtgctgtttgctgtttgaatagcttgtgttttcttttcattgtgttattgttatatcggtcatgtgagatttctgttttggtgtatttggaggatttgtttcaagattcagagctccttttagcagttcttgtagtgctggctttgtagtggcaaattccttcagcatttgtttgtctggaaaacactatctttccttcatttataaagcttagtttcactggatacaaaattcttggctgataattgttttatttaaggaggctaaaaatcggaccccaatacttgtagcttgtagggtttctgctaagaaatctgctgttaatctaataggttttcctttataggttacctgatgcttttgcctcacagctcgtaagattctttcctttgcctgactttagataacctcacgattgtgtgcctaggtgatgatcttttgcagtgaatttcctgggtgttctttgagcttcttgtatttggatgtctaaatctctaataaggctggggaagttttcattgattatttcctcaaatatgttttccaaacttttagatttctctttttcctcaagaacaccaattattcttatgtttggacatttaacatagtcccaaacttttcagaggctttgttctcttttttgaaattcttttttctttgtctttgatggattgggttaattcaaaagccctgtcttcaagctctgaagttctttcttctgcttattcatttctattggtgagactttccagtgcattttgcatttctctgtgtgcccttgatttccagaagttgtgattgttttttatttatgttatatattttgctgatgatttttccttttatatcctgtatgatgttttttatttcagttagacttcacctttctctggtgcatccttgattaacttaacaatcgacctgaattctttgaattcttttactggtaatttggagatttcatcttggtttgcctccattgctggtcatctggtgtgatctttttggggtattaaagaaccttgttttgtcatattatcagaattgtttttctggttccttctcatttgggtagactgtgtcagagggaagatctgggactcaagagctgctgttcagattcttttgtcccgcagggtgctcccttgatgtggtgttctcccccttcccctaggaataaagcttcctgagagccaaactgcagtgattgtctttgctcttctgggtctagccacccaatggagctactgggctctgggctggtactggggagtgtctgcaaagagtcctgtgatgtgatctgtcttcaggtttttcagccatggataccagcccttctctggtggaggtatcaggggagtgaagtggactctgttagggtccttggttgtatttttgtttagtgcactggttttgtgttggttggcctccagccaggagctggtgctttcaagagtgcatcagctgtggtaatataaggaggatgcaaacttgccctggagacacgtggttaagtattcaggtttttcaggcggtgggcagggccatagacctcccaagagattatgacctttgtcttaggctaccagggcagtagagaaagaccaccaggtggggggcagggataggagtgtctgagctcagactctctttgggtggggcttgctgaagctgctgtgggggatagcggtgtggttccctgaccaatggagttaagttcccatgggattatggctgcctctgctgagtcctacaggttgccagagaagtcaggaaaagcagacagtcacagatctcaccccgctcccacacagctaccagtcctaaaggctggtctcaatcccaccatgcccctccaacagcactgagcctatttccaggcagctggtgcccagggctgagaatttgccccagaccatgagcctccctactgaaaaagcaagcagactcacagtttttctggtgtctctgggagcctgcagcagtgatcgggttccttcaaagggtctgtggattctctccacaaaggtgtaattttttaacttgggtatgtttttcctgaaagtaaatagatttactaatcacctaaactagcatacttctagttattatttaaaattatgaggaatataaattcatgtttgactaaattgaaccattgtgatgacagtcttttatttccagttataacatttagtagtacgtcaacttaaagaaattttccaagttgtttagataatccttagattgatattgtattagttgatgaacattaactggatgcctagatcattcctatgtaagataaaatactgaaatattaattattaagcataaattgaaatttgtatactttggctttttagtagtaaatcccacagagaggctgtattttaaggtctatcagtgaacatgttcctttctgccatgttgagaattctatagggaaattgtgctgctgtagaaacctgggctgtatgggttccccaaaattacagaatgttcacaattacccaccctttagttttctttataaaacagatgtgactttgtataaaagtcataattaataatatctgaatgagactctgctaggagtcttaaaaaaatgagacatgctttgattaaagtaaaagaatatagaatgcttctgtctataagtgaaatgacttttgttccagaataagaaagaggatggtgaagggcaacacaacatatagagatctgtttgaggttcacagaaagtgaatctgaaagggaccacaaatttgtgttaaaattttgcaaaacctggttcggttttgatgggtgtattcataagatttccaaatgcaaacctagaatttggtttcttttcaaatatagtcacagtttctttggagtattcatttgtttgtttttttgtttgtttgttttttgttttttttgagacggagtctcactcttgttgcccagtctggagtgcagtggtgcgatcttggctcactgcaacctctgcctcccaggttcaagcgattctcctgcctcagcctcccaagtagctgggattacaggcatgcaccaccacaccctgctaattttgtatttttagtatagacggggtttcaccatgttgatcaggctgatctcaaactcctgacctcatgtgatccacctgcctcggccttccaaagtgctgggattacaggtgcaatccattgcgcgtggcctattcttaataagaggttgtaaaagtttgctcttcacattagaggccaatttgcccaaatagcagagatgctatatctcactagaatgacgttccacactgtgtttttgactttgtcatgctcttgattattctcttaaaaatacaaaaaaatacaaaaataaaaataaaaacccacaaatactctcattactgaaagtgttgagtttttgtttatgtaaatattgtattgtcactttgattaataggcagccaagccacagccattcgtacactaagacacccatgatcccaatcttaagtgttcaaatctcctggcaaattttaattttgcctttctcaaatcaaatccttaatggaaaaggaaataaaaaatataaaaccttcacagtgtctttggcacattaaggtttctttaatatttcccaggctatcttaaagactttcccctggaaattcacaaagatttcttttatgcctgatggaaggagaagtaatagaagtaaatatgttcatttgttatgttactattgatgagtttcataattgtccaattaaaagtagatgctacttaatatctaggactaccctgaatttgcatatatcatataatcatcatttgtgaatgaatgagaaagattatgatttttgataatttatttcagtggttataatcaaattttcagataaaatagtgaacaaggccaggtgtggtggtgggcgcctgtaatcccagcactttgggaggccgaggcgggtggatcacccgaggtcaggagttcgagaccagtctggccaagctggtgaaaccctgtcgctattaaaaatacaaaaattagctgggtgtggtgatgggcgcctgtaatcccagctactcaggagtctgaggcaggagaatcacttgaacctgggaggcagaggttgcagtgatccaagactgcgccattgccctccagcctgggtgacaaagtgagactctatctcaaaaaaaaaaaaaaaaaactgaactaaatgtttaataatatttatgaaatgtagcctatgtcactagtatgactttttaaaattatttaaagagattttattttgtccagaatcttggcagtcaggaatcccaaataaatgctgcaactgataagtgcatcattgttagctgatcttaggaaaccatcacaggcatttcaactgtgttttccaacatacggatttgtttgttgaaatgtagctagtcaattttcatttttccacaagtcaaccagctgatctcgcagcccaatcagtttttttatttttatctttccaccaccccccaccacctccactgctggaatacatttgtagagaagttttcaaaagtttagagtttaagaattctgtttctagattgttaattgtgcatatgtgagaattatgggagatgacactgatcctgtttggtgaccacatcacataataatggaaatgtttccaaacataccattttcaaaatattttctccataataaagtttattttttaaagctatattttcattgttaaagtgaaacctccattttgagtaaatagagtatatgtcatttatttattgatttaatatattctaggaagtaaatcactgacgaaaaggtggcaacttttgaattactcctcatttttatgaaaagaaaacatacataacttctgttaaatttgacaactctttgaagtactctacagtgagtgaaataaccagtaagcctccatatggcctgagggatttccatagtcactcttcatttaattgcagagtattgtacagattttacagatttttaaggtaatgaaatccataaattcctttacatggacaatatatcaaaatatgttaaagatgtacaaatgattgaggccacatcaacctctttcccctttcaaacttctactttctcctctgaatagctgctatgatgtgaatgtcttataagtgtctgatgtaaactgggtgaggatcaggatcaatctatatatgaaatattagcaaaactttgaaaactttttgataaaatggatagaggaaaaccaaaagctcttaatattttcttctagtattccaatggatttgacttgtgtgcctcatttttggaagtcagtggaataaattgttactttacttttattttatttatttatttttttgagaggtagtctcactctgtcacttatgctggagtgcagtgatgcgatctccgctcactgtagtctctgccttcctggttcaagcgatttgcctgccacagccttccgagtagctgggattacagacgtgagccaccgtacccggccccaaattattacttttagatgatcacttttcacttcctgttagtggcatattagtaagagtttctgataccataggaatgtacaacatacaagtcatttttgaatattccagtgacataaactcttcagaccatgaacccaaactgagaatggaatagaaagtgcttttttaaccctaaagtaagaagacttcctacagaaggtgctgttggttgcctatcatatttcccagctttgcctttcctaatacaacccgtatttttttcaggatccaccctcctcccataacccatgtgctttcagggtgggctgacccttctccacacccaggccaacatggtgtaaaccaactcatccccaacgtcagtgattcattttggaatggatacgtattacagtttggctaatgaaatcagaggcatagactttttgggagatgcttctgtgctaaaatttcctaagtcttaaacacacacacacacacacacacacacacacacacacacacacacacacacacacacggagggagggagggagggaaggagggagagagagagacagagagaaagagaaaggtctcttttcctcttttgtatattatcaaaggacatgatgcctggagatgcaggtgaataaggctgaagatcacagaatggaaggaagccatcatgtctttagacttacagttatgtgtattaataacttccccttatttgtttaagtagctgaattgaggttttctgtttggtgtaatttataacccactaacacatcataacttaccaatacatggactatatactgttatatggtaaggcttcactcattgttattgagtattattcacctacatttttttttaatgtgcttgtttggttttcctacacatagcaccttcaaagcgggaatccttaagattaatgccaggatatcagatattagaggatgttagaggcaaacaaatgactgtgggggatatgaaagctgacaggctacttttgaaggaagaagatgctaaaaagaaaaagagctgggagacacagacttatactgtaatacacaaaatggatactcgttattatggctttgagacatcaagggaaaagttgaattatcctttttatataaagactgagaagtgtatattttacaaagactttcatcaaaaaattctaaaatgtattaaatgtgtaatgttttttgaagagggaagttatgcagaacattgttaggcaggcaggatattctttatttctcccaacacctagtacagagaaagggatgaaggacatacttaaaatttgttaaaggagtaaagagatggatttcgaagacaaatgatatataacagaaacatttccaaaaacactgttttcgaagtgttttctccgtagtaagaaacctagctctataacctaaatctattttgcagtttcataacccatctaacatctgaatgattacttctaaatatttttctctacttaattttctatgatgtctgttccccaatttatcttctttggatgtttaagaaaaaatattacaaagaagttttgaaggttttcctttttaagttatgcatagaaatgtacctgccaaatttcgaatttcttgtcaaatttcattcatgtagcaagatgagatttcagggtcacagtgaaagtctatgaatgaaaaaaaatgttaaatattcatattagtgatgcatggggtaggaagtagtggggagcggtcctcctaataggcagacaataaagggggaacgtgtttgtagaataatttagaaacaataaggaaactaacaggtgatctactttttatcaccgtacaccagcaattctaaacaatgtctgtgatgaagtattttccccccaaaatattctactggtctatattctaaacaactgatgtggctactgtttgttttaatcatctttatgtgaacttcaaattcgcacattattggtcatccatgaataaacatttaactctacatagcagttaacttgaagacctcccaattgcacatacagtctctaccacacagactcaactacatgcatttattttcagagtaaattcataatagtttggaattgcctgagctacctttgggagaagttactgtattccaaccagtggtactagatttttttttttctttaaacaggagaattcatgtaatgaatgatggcacagtaactttaaagataaagacataaaacatgacttgcttaaattttgacattgtatgacacccctttagaatttttgtgttcagaaagttaaacagtgaagcaggatgtgacctataaggggtagtatttttgtttgtaaggagtacatttttaatgaatgaaatatgttactatattggaaaaagacatttacagtgaaaattattttattgttttgaaactaaggaagaaattcagaaaataatgactatcactgagttttgcatgatttttagtgacactaattttatcatgtagaggaagagggtgttaaaatatgattcactttcgtagtcgggtaccctattacttctctaggtcatccctcctatgtaacatgcacactgttaaggcatgaattaattattttggaagtcaacttaccaaataaaccagtgctaccattttctagtctccatggatcagtttgagagccatgaaaaggattaaaatgatccttacaatatacagatagtcttctagtaagtcatgacacactgtaattaagttgtaactgttagtctctctgcttgttcctttcctatcttgaaatgaatatgttcaagatcaaatatgaacaagcatttactcagtggaagatgaaatgggtatgatatgaatagattaatgacatcacatgtgccttctttgaagaaattaattatccaaatgatgttagtgacgtgaagcctcctgggggcacttctcattctactttcagtaatgagctgtatcctgtcaacttactcagcaaaattcacaggaatgcatgtttctctttcatgggacacttctctgggacttaatgattccacactctttctctttttctactacctttctggattttcttctctgtctcctttgctggctgatatttgttttactagcctttccacatgagagttttttaatactatgtcctagacttcttcctcatctcatgttatattcttatcaaagataatctcatgtatgctcttgacttcaaccagcatgtatgagtggatagcgtcaaaatttctatctccagtctctccataaactccttgtagtcactaacagttggagattgccacctgactgtctcagggacacttcaaactcaacctttatgtttcaattatctattgtcgtgtgaatattatagctaaaacaatgaagatttattatattttaaaattctctgcactgactgggtggtttttaatgctccacttggtgtgggctgtagagttactcgtgcatcagatggaggctggactagttggaacctctaagatgtcccctctttccacatgatgtctcttccatcagggcctcttcatatggcctctttctttaacaagttagcctggactttttaatagcattacagctggatgtcaagattgcaaaagtagaagcttccaggcctcttaaggccttgtcccagaagtggcacagatcagggaagcccattgctttagccaagtgcatgtacctatgaaaatcttaagttttagagataaagtaggtattaccatcatagaaggggtttcaaaaaaaaaaaggaaggaaggaaggatgggagaaagaaaggaagaggaaagggagaaagaaaggaagaggaaaggaagaaagaaaggaggaaaagtaggaaagatggaaaaagaaaagaaaataatctcaaatcagcttcttaaaataagaggaggaggccgggcgcggtggcttatgcctgtaatcccagcattttgggaggccaaggtgggcggatcacgaggtcaggagatcgagaccatcctggctaacacggtgaaaccccgtctctactaaaaatacaaaaaattagccgggcgtggtggcgggcgcctgtagtctcagctactcgggaggctgaggcaggagaatggtgtgaacctgggaggcggagcttgcagtgagccgagatctcaccactgcactccagcctgggcgacagagcgagactccgtctcaaaaaaataaaataaaataaaataagaggaggaacaaatattcagcaatcagcgtcattgacactgacacttgatcagtgtctgaagtgagagcagctgttaggaaatcctacttctatctatcaagaagggtttatttaagaaaatagatgacatacacgctataattatcaatatagtttcttccatgggctaccaagtccaaagtattattgcttttgcataatttatgctgataaccttggaatcatggtttggatggtttaaacctctctctccataccaattgaatcattcatcaaatcatatggaatctccctatgtgtaacctcccgtcaagtcctccattttaatttctgtcaccactactctgctgtattttcctttcgcctcaaatttgaggtattataaaaatcttataatggcctatcccggatctaagctatcttacacattaattacacagattccccattgcttatgtaatacaggccaaacatcttagcctggcattgagtgttctctataaatcgttgctttaactttatttctagctcccttatacacaaacttccctataaggccaactggatgagtttcctgtatttaattggtcaagctcttctccacctgaattgttcttccctcatactaattttcccaaatcctgccttctttgtgtgtcttggctcaagtaccatcacatatctttctggaccaccctagccttcaatgatcatcagtcatctatgttcctcttaaaatcagagccaattggcttttagtgtaaaccagtttactgtttcttaaggtttcacgagtcttaaattaggtaacaaagtcttctggaatgcatcaatataattagtcaaaaataaatgttcaatgtatttgttttctttacttttgaggaaaaaagaaattaacagtctcggattatgtatctcctttatacaaagctgctgtctgccaccaaacttattgggaatgaaatgaacagcataagaatctgcttttagaaccagagacagggcagatctagggatccaggtgtcaagaacctcccagtattttcaggtattgaccatcaggatgaattaaatcttaccatttttttttatttttctgatacattttgttcataaattaatttgaagagagagtgattggcagagcttcaaccacacacactttctacttgaagtatgagggggagtgggtctgatgaaaacttgaatgacttcctatcaagactagtgagagagaggtaattctccaaaacagactagtgaagcagttatcagaaaagaaggaagcaaatgttaggcaagcatgtaattctttctttatattaaatcatatgacttacctgtgtttaatatattcagagcctgacaatgagagagaataacttagaaagcaagggagattagttccagtagaaagactaatatttattttgttgagatggtaggaagtgggagtagaggaacaattcaaaagctgttcttgactcgcttttaaactcttcatggtggccagaattgctttcaaaaatactatatttcccgtagacagcatattaatttgcatttcaagcattttgataactgttaaattatttttgtcttgaatacactattttatagtgttttataatgctagttgagctctctggaatttctaagaaaagttccagaaattaaatctcctgggtaatgtgtgaataacagaaaaggatccaatgtattctcaccaaaagataactgtccctaatgttaaaaagcaggggaagatgtcatcattttattgttaacctgacggtgaaactggagaattccctgaactccttgcaggtcttgtgacaggggtgtgactcgtttgttagtttgcgcaattgctgctgcacaaaccccttacgggatggggagcacacagatgggcaggtgcaggagccggggcaagcacttttgggctcctgccccacagtggcgtctagggttgtgttacaattaatgctcttttagcagttgccatctgcacatggctaagtgttgaggactaagctctgattttttatcttgcccaaattcctacctaaggggcctagggagtcatgccctacaaaccatgaattctcatcagatgggttttatttgaccctatatattgtgacttacttttctatctgactctggcataacattataagacaaggaaaaaatatttaaccccaaaatatatttccttgccataccttgaaattgccctgcaaagtctcttgtgggaaaaatccacattctatagagaatccctttccccctttgttttccttcctttccttcctgatccaggagataatcaactaagagccaggtacccttttaggtccaataagaaacattttacaacctgctctctccctctgaagtcttctgtctgagagcttcctctgcacagtaaaacttggtttccacagtcttatactaacctgaacattcctttccattaatcccaggtcttaggtaaactcaaccaattgtcatttaaacatttaaaccagaaaatgtttaaatttacctgtagcctggaagcccctgctttgagttgtgccacctttctgtaccaaaccaatgtatttcttaaatatatttgattgatgtctcatgccttcctaaaatatataaagccaagctgtaccctgaccaccttgggcacatgttctcaggacttcctgagggctgtgtcatgcgccatggtcactcttatttggctcagaataaatctctaaaaatattttagagttttactcttttctcaacagtgttaaactggctcagtggagagtcatagtgacagccttttgcaccctgccctcttggtacctgggtccttgtctggtgtccaggaagaatcaggtcagacatggacttgaaggatgttgaatgcagggattttattgagtgatggaggtggctctcagtgggatggatggggagctcgaaagggtatggactgggaagatgatcatcccctggagttcagctgtccttgcctgatctcctcttggaccgtccccggcctaactcctattgacattcagacactccttctcttttcttctctgctataccactctgctgctctcctgctcttctgctcatctgtccatggagcctagggtttggggtttatatgtgtacaggataggggggcatagtaggacaaaaggtaacatttggatgcaaaaacaggaatgcctgttcccatttagggctgcaggtttccaggcttgacatgaggcctttgctaaagaaccaccctcttctacccagtatttccctgcctcctgtccgtatcaattctatttaattttgtaatagagcaatgggtaatatttttgagtcaatggaccctttagtaatattttttaagtcaatggaccctttagagttaccgatgacagccccagtattctctccccaaaacatacatttgcaaaatgacacacaattttgcatacaagttcagaggatctacatgtttctgaagcccatctatggatgccagatttaaactcattttattaaaaaaaaaaaaggatattagaactacaatgaaagagcacaggagaaaggataactgtctttcatgggaatgtgcacttttcaattttgctgtattttcctaaattatctctcagctaatacctgacttcatcctttgttatatggcagcaaatctcactaaaatggaactagtacaaggatcctagactttatcactcctcctcccacccatctcccttctgtagtatgtgttaaataagaaagtttttagtgtgtttctgagacttgttcctgatttgatttcacacttcaacagtagtgatccttaattattacttaggaattactttatgatttggtaatatttaaggacttaagctacaggttacttttttaatccttaggtgacatgctacctaacactttctctctgcttattttataattctaatttgagttattagctcttaattactcaataattattcactgaaccctctgtatgtgccagaaactgtcctaggtactgagaataaacaaatgagtaaacacataagtttcctgccctctgggaatgcacattcttaatttactaactgttaaattcaccacatacttttgttaatttgtctgttttagaagtctggctaacttgtttaaaatttattgtactcattctttctgaagtggctcttctacatcagcactatcaaataaaaatataatgacagcccaaagatgtgattttaaatattctagtagtcacattaaaaatcacgtactaagaaacaggtgaaattaattttaatagtatatttagttaacccagtatttacaaaatattgttatttcaacatgtaatcaatgtaaaaatttattgatgagatattttgtcttttttatactaagtctttaaattcgggtcacatttcaagtgttcaacagctacatgtagctactgattaactattggctagatcaggccaaaatgttcaaccctagccacttgctcttcctccgagagcttcaatctctcagcatttcttatgcagagctacttagctccttctcagatcctgtctctaaaatacaataacaattcgatccctcctcaagctccttaatgtcttaattcataaagagactcttgccatgaactatttgcctaggagggcaatgaaaggttataaattcaacattgacaacaaaaacagtttgctataaatgatagataaatgataggactgaaagggataacgtgcttgggtcagcgaaacttgggtgtggtaggacaaatgggagaagctgggtttttttcgtgtgtgtgtgtgtgtgtgtgtgtgtgtgtgtgtgtgtgtgtgtgtttcttttttttttttttttttttgagacagagtctcgctctgttgcccaggctggagtgcagtggcgcaatctcggctcactgcaagctccacctcctgggttcgcaccattctcctgcctcagcctcccgagtagctgggactacaggcgcctgccaccacgcccggctaattttttgtatttttagtagagacagggtttcaccatgttagccaggatggtcttgatctcctgacctcgtgatctgcccacctcggcctcccaaagtcctggattacaggcgtgagccaccgtgcctggcagagaagctggtttttaaaatgctatgttcttatattatggaacacttacttgtcctctggtatactcaaaattatgaccaaggatcttctgagagatttaactcatctggagtaattacatccgctgacaaatgcatatatagtgccaatgtcatacttgccttgttttctcaaccttccaattcctaggcaaattgtcagattctcaaggtaatagctgtcccacatgagactctggtatgtgcagatctttattgtgacagttccttttggggcttctgtgacccaatgaagtgaaaataaagatgaaatatttcaagattttgaaaagtagtttctattaaaagttattcgtctaaaatgatttctgttttatagtatttagtgcataaagactggaataaaatgctgtaaactaactcatttaatatccttctgtgaattcgaatgagaaagacaaattgactggattaaaaggaaacattgagtaacattctgtctttagttaaaaaaagtccaacaccagcaagacttaccttcttttacttacacatatagttaatattagtgtacggtaaagcttctccacacatctaggaaagaaacaggaaaatgcattatttcctttgaaagctgcctaaacacaaatctgttattcttctgagaaagagtgatgcctatacagtaaaaaagttattctaaggaaggaaaaaacaaaatacagtatgtctgttgtttaagccaatagatgtctttaaggaaacattttcttaagaatattctttacaatagtgaggctgaggcaggagaatggcatgaacccgggagacggagcttgcagtgagcggagatcgcgacactgcactccatccagcctgagcaacagagcgagactccgtctcaaaaaaaaaaaaaaaatctttacaataatataattttcaaagttctcagaattctaaaatcttgctggatgatacatagatgtatagacatgtacccaaaggtgctctactaaattaatcactacctccaacaacctaaagattacagtttattgtttaaatgaaggatgcaaaatataggtgtatatacaaaaagcccctgttttatagctcttctaaatgtgagtatcacacacgggaaaaatcgaaaaacaaatgtaagtctaaatctccttacagagaagaaaatgtagtgtggcctggcctaatattacgacttttccaaggagttactatatatggtttaacagaagattatttccatcaaaaatatccattgcttgtgaatcttaagaacaggaagtttttcaatccaaattaagctgaagaaaaacaaaggagaggaggggaggggaggggaggcgaggagaggggacgggagaaaaaagttctctgctagcttcctaagcagttcagctctgagggtatgctttgcagcagcaacagcacacctgcccagaccactgcagcaaaggctttcaacaattcttgggaaactaagtgagggcaaagatacatggtagttccaggacatcccacagtaggatttgtctcacggaggtaactcagggaggaagaagtgagcagttcactctgccttaacagtttacatatatgaactactaaacttaaaaaaaaaagtttttcaatccaaattaagctgaagaaaaacacacctaaatagtatatacccaaagtattatgtggcataatattttaatcataaaaataatatgtatctatttttgtttctcctttatagtcaaagcactgtagaagtacagaaaggattgttctgagagagttcttgaagtagaggttgggggaggcagcctaggattcttatctgtaaaatgtgtggttccaacatcttatgcctacacttgatctcactgctagattgtgggcaaggtgctttgaagggatgggcattaaagggaccctccaataagtgaggcttaatggagtttgcagagatcatcatattctagaaatcacacatgccgtttttgtaggaacagagacagggtcccaaaagtatcactggatactggagcagaaaatgagaaaactcatcttgtgatgccaagagaagcaaagtcttcaagattctttctggtttatttctatagtatagctatcaatgttagtggcataatgtagtatttcatgttcattctgggtcactttagactcatcgtagcactgatttggaggaaaacagtatgaatgggcacaactggatgatccaggagggattcttttttttttttattatattatactttaagttttagggtacatgtgcgcaatgtgtaggttagttacatatgtatacatgtgccgtgttcgtgtgctgcacccattaactcgtcatttaacgttaggtatatctcctaatgccatccctcccccctccccctaccccacaacaggcctcggtgtgtgatgttccccttcccgtgtccatgtgttctcattgttcaattcccacctatgagtgagaacatgcggtgtttggttttttgtccttgtagtagtttgctgagaatgatggtttccagcttcatccatgtccctaccaggagggattctttagggaagccaggcaagtgggagtggtcatgtaggaggaaagtctatcccatagtacctgagaggtgtgcactaaacttgccacaggagacgatgctgactggggaactctattgagggtggcaaagcccacagtttaggtggaaaagcacttgaaaggggaatggattcattgcttttgtcatttttacctagactgttataagggcttctttttttatatctctattatcagtttttttcttttggaagtctgtcttttaagtttactcattaattgtataaccatttattgatcatttatacagcaggcactacgctgtattctcctaatacaacactaagaacaagtccctgtcctcatggagcctccagtccaagcaaccccaatgatgtgagagaactgccacaggatatataggagcatgtagcgctgactcactgtctgattatcatcactcttttaatgatgccaagatcgattagtgggttcaactggttacagcctcatccctgaattgtaaaattccctattagcctaaaggtgcccaggatttaattgttctggataatgatttcttaagaattctgaagaaggtttattcagagtttcctttcattcattgatagagctagtatttattcagcttattctaaacactaggcattatgttgttgctagagatacaaaactaagtgagccaagatgaatatagaggaaacataagtgagtaacttcagtgcaatatgagaaatgtgcagggctagatgcagagtcctctgggaacagaaaggaagcacagtccttaatgacagcaatctctggtgagtcaatgaatctctcgcagtttatttaggtcaggagctattaactgtcatgcattagtgagcagccaacagtgggactgggcagtctgagccctgtattgaaaagccggcaacgaaagaaacttcactagaggcttgatgaaccagttcttaaactaaagctcatgtgtctgcaatggacaatcctgcctcaacctcgtgaaaaacagaccaggattctctatggttatgcactactgcatttgtttctttagcgttcctagagttgttttcatcagttatttaagtaagaatgcccgaggtagtccacttcactccctagatccctattaatacatttcagttgaaaatctgttgtcccttgcctattttactgcttccaacattgagatttgatggaaagaaatcagctctcaaataagaatggtgtcacctgctgctggttcagcggcactgcaaactacagattatgcaaattacataaagatccaatctttctacccggagcctaggaagaggccttcttttcccactgggtcttatattctagagtcagccatttacttaatttcccaaagaatactgcaagagaatactgtgaaagcattatctaaaatacaacaaaagaattctgtaaatgttatctaaaatataataataagaaaaaccaaaagaattcataactaggctgaaagtattctcttaggattttaatattagatacaaaattgctcattagcctttaggttttcttccctctcccaagcactcaacaattgatttccttgcatactaggtaagtgtcctatgacacataatactttcaaatatttatatcttttgtaagataatatttttcatgtaatcctagatggattagtttcctatgactgctttaaaaattgccacaaacttagtgactgcaagccacacacgtttaatttttttcatgtctggaagtcagcagtccgaaatcacttttactggtctaaaatcaggtgtcaacagggctgtgctccctccggaggatctaggggaaaatcattttccttgccttttccagcttctagaggctgcattttcttagcctcgtcttccctcttgttgcagtcgtcccaatgacttttgtctctgtagtcaagtctctctttgcctccgtcttaggaggagatgtgtgattaaattttgcccacctatataatccaggataatcttcccatctcagaatccttaacctagtcatgtctaaaaagtcccttttaccttataaggcaacacaaattccagggattaggatctggatatctttggggaccaggaatcagcctatcacactaggtaatgaagtcattatcttaatctgaagtatctagatcctcatataatctaactcctttagtctatttgagttgttttaattttttctcaagtacattagctgccaaatttaaaattattgcagatggaactcttgtaggtctataatgtacagcttgctgagccacagtaaacagtatcatttttagctttctatcaatgtttgacatacaaaatggtcaactgcagaatgtttcagtgacttctctagaaccctattgaatatttaaaatgtcatacatcatgttgttgagtggtcttcgtggaaaaaatcatgtttttaagaaatctattccccttcgatttagtgcttgggtttgtatattccgatgaactgatatgcaactagagctatataactaatcctgatttttaaaaatttgtcttggcttccaggaagtacagactaaatttagtatataattacagtaactattcttagctagtatttcttgtataattatatattcttcaccccaaccccaataatcatttctcctactccttactaggatgcttttgataatttatcttcatttaaacaagcttattgcatgggttttctttattataatctatctcaaaatcttttttggaagcagatatgaaataaagcaaacaaacaaataaacttggaagatatatagaccctatgaattatagcccatctgcatcttttttgagtgccaaagacataagttcagctatgaatacattctgttactacaaaagcactttaaaattgtgtttctgtgcattatatagctccttagaatagacagatatatttagaggggaaggatatgctaatcaatgccactagagccagtagttttcttgatttcattcaataccttccagttttaataatttgcaactgatatcaatgatcataataaaattttaaattaaaatgtgtgagctgtttttttgttaatacttcatgcattgaagagacataaacaaagttttgaaatcataactacattttctgaaaggcttccacaggaaaaaaggcttcatattgatattattttgtacaattttttggacaattttccctccttcacattcagtttattagaactgaacataatatctgacataagtgattcatatatgggctaaataattcatgtatatcagaggccaagcctattggatatggtggaagttttgaaaccctatctttgtggaacaacaaaaaattaaatgtaagggtcaaaatgtgagggctcctttctcatttgttctgtgaatccagtttctagtggttacttatcatatcaaaatttctcgtggcgttttcagagctacacctccaataaacctaaatgatgactagctttaagacaatagtctatacagttacgtactgcttaaccacagggatgtgttctgaagaatgcgtcgttcagcaatttcattcttgtgtgaacatcctagagtgtacttacacaaacctatatgttttagcctactgaatatctaggctatatagtatagcctattgcttttaggctataaacctgcacggcatgttactgtactgaatactgtaggcagatgtaatacaatgatatttgtgtatctaaacatagaaaaggtacagtcatatttaattttaaatgtattaaagtaacccatttcctcttcccacttgactagctatttcctttttgagaagtagacattatgtttaaaaatgttttaaaatactgcaatattgttgatattattagtttactaaataagacaataaagacagaactcagacaaataaaatgcagcagctgtcagttgatgggggccgccattacttgtagaagaaaccttcagtaagcgttgaactagtggcctgggatagttgattttaagaagacaaataaaaatgcctggagagaaaaaatattttactcattccatatgagtagaaaatatcctttgaaatattatcagtgacttacttacgtcagtctttcttaacttgggttgtctgttaaatactttaatatggcttttgccatagctgggtcattgctataagttaacaaagggctgttttctatatcgctggaactctcctttgttagaaccttctttaaatagaaagaattctcttgcagtacgtggtaattgccatagattattgaaatgaaaaatggctatgattactcctaacaacttgagatgttctgcttacagtggatgttaagaacatatcttagtaatttaaaatttttcttaataggcataagcaagtttttattctttaaatgtacttcaagtggttacaactaataaagattggtatataacaatagagaagaggttccaaagtaaaaatccacattaaaattaaatttaggttacattattgcttagcagtttaaaacaatatgttccatatatacatacatgtgtatatatttatatgcatacaaaacatacatgaacatgtataagtatatggatgcagatgagtatatgtacacatatatatagaataaatgcataaaggtatataaatatatggctgcatttgtgtaattggatatatatgatacatattttatatctgtatgtcatgagtatttttctcattttttcctctttgagaataagtctaggtctatactatcaataaaatattgaaaattaaattaattacccaagtgaaaaaagaaagttctcagagttatgctgttcatacttatgggagaagtgtagattttttctgatttgcttatcttttcctttatttaaatgtaatttttactgatatgtaatagatgtacatttttaagggtacacatgacaatttaatatattcatataatttgtaaagataaaattagcataattggaatatctgtcaccttaaatatttatattttctttatgctagaaatacatgaaatattctcttctagcaattttgaaatatacagtagattattgtaaactgtagtcaccctactgatctatcaaatactaggtcttatttttttctatcaaactctatatttggacccattaaccaatctctctttatctccttctccttcctacgctgtggtaacaaccaatatgctatcttcttgagatccacatttttagctcccacatatgggtgagaacattcaatatttgtctttctgtgctggcttatttcacttaacatattgaccttcagttccatccatgttgctgcaaaagacggatttcattttttatgtctgaataatattccagtgatctgccagaactgaattttaaatggggttttaggcctggattgactttagataagcttataattatagctctctacttgtggtaatcaatagcataggcctgaatgtgttattgtattaaatatttctcattcattgacatcacaattgtggatcaaatctctgtggtttggatatttgacttctgacaattcattgttttgtctgactttaagttgtgtttaagtgattattttcttggtttgctctcattccaaattactggggaatttaactgatgaatgaaccagacatatatttaatatacatctgctgtgtgcaatatattgtactggagggatgggtaggtatagacatgtaagacataatctcttacttcaaccagaatatggtttcactgggttcctaagatcaatatgcataactgcagggacctcgtgctacattggatttgaatctggggctccagttccagtcccattccttcatggccatgtcaccttagcatgtcacttcacctatggcctcttaacagttagataacccaagaccactactatttctgaagagtatttttttaattacaagccaaatcagtatcaaatattatatttataatggttctgtgtaatttactaactcatttaccataaaatgacatatattgtactattagaagaaaattgtgggatttattaaaaacatcaatttattgtaccacacacttgatatgggcttataattgaacacaaatatatagaatatgaatatctttttttagttctgtcattagctctttgagtgagtatataagcatattcataaatgatattgtatctatatttatctatgttttaagaattcttgcagccgggcgcggtggctcacgcctgtaatcccagcgctttgggaggccgaggcgggcggatcacgaggtcaggagatcgagaccatcctggctaacatggcgaaaccctgtctccactaaaaaaaaaaaaaaaaaatgcaaaaattagcctggcctggtggcgggcacctgtagtcccagctactcgggaggctgaggcaggagaatggcatgaacccgggagatggagcttgccagcgagccgagatgcgccactgcactccagcctgggcgacagactgagactccgtctcaaaaaaaaaaaaagaaagaaagaaagaaagaattcttgcatctcaggcatggccaagaagcatattgcccttcatcctttctcaaataccatagaattggctctgacctcacctcagtttacttatgtttcttaagctataagatgatttgtaagatcccattcacacttagtatcctatggttataaagacattctcttgatagttatttgacatggtgtacacattggatcaatttctttggtgaaaacagtctcgccatgaccttgatgtgccatttgatgttcttggaaataccgttcctctactgttaacagtaaagtttcaaagaaaatagattcccagattatttcaaactcattaatataggaataatatttttaattcttcaagatgataagattttacacattttgatgccagtaaataattttgtgataaaagcaaacacctggtttgctagaaaatattggcattccgcaagcctaaattcattagagaggaattccacgtgcatcgcctctgagctgcagctcctgtgaactgaaaaaactgctagttaatgtctcagaagttattaggaaatgtaaagtacatacaattgtcagtgcttcaaaaatagagataacatcttagtccttatgtagcccccatagttagctggagcttggacatattaggaagtcaataagaatactgacaaactggcatgtaagtcaggtttgcctgcatcaggtttgaaaattattctattttagaataatcttatttatcctatcgtttctcaactaaattgatgtgtagtccatagatttcttacctttgctttatattcctttagagctgtgatgcaagctaaatcatttttggggaaaataacttcttaaacatttttgttgttgttaatgcttcggatgggcagttattgtctgaacatcatcaaggcacaagcaactgactgtagcatccatatttttttgacagttttcattgcttatgtgttccaagagctgcctacaggatttctttccttatatgagaaatattgtaatgatactcaattatgtataagagcaagattcctgacttgactaaatacaactactttagtattcactatttaaactacgtggctttttaataagtaaatcaacattaaaaagtgaataggagattgcaatttagttttcttagaaaagcttgactatttttattatctgatattcatgtcacatgtaatcacacatttgatttttaagtaatttttattggcttggcatggtggctcatgcctgtaatcccagcactttgggaggccaaggcaggtggatcacctgagcccaggagttcgagaccagcctgggcaacgtgggggaaaccctgttttttacaaaaaatacaaaaaaaaaaaaaattagctgggcttggttgctacatgcctgtagtcccagctgctagggaggttgaggtaggaggattgcttgagcctgggaggtcaaggttgcaatgagccaagattgcccccactgcactccagcctgggcagcagagtaagaccctgtctcaaaaaaatattattataattgaggtgaattaattgacatctatatttatgaaataactatgaataatacaagatggccacttgaaggtatgccctaagacaggggtctgcaaacttttcctgaagggaccagatagtacatattttaggcttgtgggatacacaaatttagtgctactactatctactatcttctgcctttgtagcacaaaagcagtgatagtcaatactgaatgcaaaaatatgtgcgtggctttgttccaataaaactttctttacaataaataaggatgggccatagtttgttgacccctgccctaataaattcattgacttggcctaattttaagaatcatataattttaataaaagtctgttaagtttctttatataatttgtaacatcagtaatatttttaagaaaaatgtaagtcatctgaaagtataacctaagtaaattttatttgatgatttgaatggaaatacatgatgattttttcttatatttgatttaaatatattgatctaaacctacctgttcttaccataagcctagctattataaaaattatacaataacttaatttttaaaaattattttccctagaatgtactggactcttggacaaatacctccttattattgaactttgggctaaatgactgcaaaataaatgtttggtcttgatttagctaagtgtcttcaaactacacaattctatatttctgtgagtgtcatatcatttgccggtaggactggtgcccttgtttgttgtgttgttttaaaactctctcattgagaatgtcacttctccaagtgatcatattctttttgaaagtcacttctagtttctatataaaaaatgtcttctaaaatcaataccagtgaaagttaatcagtgatataatgattacaggatgccttatttatcattggaaggctaagatggttatctctgtgatgatccttccatgtgatttgaaaggacagaggggtagctttttctggccatgccacttctaatttgtaaaatgcccccattataactcttatgtaagaaggcagcctgcctttattgccatatcctaaaaagattcgttagtattatgcccaagtgctcagtatttcaccagccctgctcccgtcttaaatttattatagattcgacattgtcataaagggcataattagaaaatcatctcacgtctcatctcattatgtaattgtgcataaggaaacaatcattttaaaatataaagaagaaagatttgggtcatgcagctgcttcctaaatgttatatttttatttccattgcgtctgtttttcctcattgaagtgcagagattactcatattgagatacaactatttttccgcaactgagtcttcaatgcctgctattttattagccccaaataagagatgattggaagtgtatcaatgcaagtggcaagtgagaatcagcaggttcattcttcataaacccttctgtagagcatgctcatgtttctggtaactggcttttctttctgctcctctttttgagtggttacagtggaagcaaccacatttttacaaggtgaccatatctcacccatagagatgaagacagaggtttgctcattacataagctgaattaatataagtccattctcaggattttaaagttggaactagaaaatattcacccactgaaactctgagctcttaagtaaaagtgatgcaaactcacaagctgttggcagaagttgttttctgatatgttgtttttaaaaatagaaatattattctaaaaagagagagaagaaggaagaatgaaacacacacagagagacagagttttgatatgaaaaatcaacgtcttgtttctctacagtgtttggatcagtggttccagttcaccccattactcagctggatctctgcctttgggttgtgtgagatagctgtgtatatgtttaataagctcacttttgctaaacttagttcaaatgggtttccataactttgaactgaaaaactaattgtgaagtttatttcatactctacacagcctttataatatagaatgtaaatataacgcctacgtaactgttctctcacaaagtttgatggtaaattattaaaaggaattaattactcatgagatactccccagagaaaaagaccacaaaaagttcatatgtatgtattaagttatttatttttaataatttttgggtcacttctgtgagccaggcaacagtgataagtaggcaacagtgaataaatacaaaagtgaatgtctagtttgttgggggagagatgtattaaccaaataattacccagattagcagatgattttaaaatgtggcaaatgctgtgaaggaggggtgagggacagtgagccaggtagaagaggctgtacgtgaaggccctatggcaaatgcaaacaaagcatttcggcattgataatcggaagggtttttggttttggttttggttttggttttccagaaagccatttattaattaggttggaaaagcattgtttctgtttcctgttcatcatatttagcttttatgtcagaagagcatttttgtttttgtttcaaatgtgtttcaagtcacctaaaaccctctgtccttaacattattcaagaaagtatgtaatgtacaatgttatttacaccatcgatttgtttaacgaactctctctttgtagtcaatgccaaagaaaatttcgtctcacgtatattcatggtttcctgatggattgaccagtaagttactgaagtcctacttagtgtgatgtgactgtggtggtgttccatcacattattctaagccattctcagccccatctaaccccggtggtattcagcaaaggcatacaagcccagaaccatgggaatgttcatctccatcagaattaataggaaaagacactttagtaactgtctttagtaagatacacttaggggagcagcgtgaagtaactctcttggactagcatccctctgttcttaaactgccaccaatgctactgtaacattgcagtcatattctaataaatggtgtcaagcatagaagagagaaaaattctacttttgtgacttctcctgatttctgagtgctgtatgcatgaactatttacctgtgtacacaaacagctgtacatttagttgccatggcaatgcttatctgttatctttacagggaacaaaatggtactttaaccacagttgactcatcccgtgaggtaaaattgataaagctgcctttcttaactttcagccagaatgcttcagttggcaaaagttggttgtttttgttcttcttaaagaaaggctacttgttgacaaaggcaggtttaacccccattctcaataattgatatagcctcgagcaaagatcaaagtttcctggatatcattgttataatttacacttagtaactggacaggagatattaataggatggccatcagagaaattgtgttttcctgacatgtgtcttcttggattacaggtaagtattggtgaatgcgtgacactgataactgctggtattattgatgagggactatcaatgatctgatgcatagggtgcccttgataagaaatctttattgttcatcagcatgttactgaaaagagtccagccaatgttaggtatgtgaggttaagaattccccagtcactatgcaacttggaaatagaaaggacaagtgattctaggacaaatgtgagaatccatgtatgtatttataggcatgatacccaggcagaattattaatatcctcccttgggctcccatagcactgtgtccatacttccatcatgacacttcacttcaaattaattttctttctatcccgttgggttactagctttttgaagtagatggcgctattatttttattgattatcaagtccgaagaaggaagagctcaatacatgcttgttgaataaagtctgctttgagaaagttatgctcattttgctttaatattctgcaagagatacaaagaaaagaaggaaggaaatctgagagctatcagttgactggatactcgaattggattacttttagggcaatgctcttggttgtgcctagacttgtaataatagctctgatttcaacttatctagaaaagcttaaagaaaatagtccaggactgagaaagctatttttcattttcttaaataattggcacctttgaaaggctccagaaactacagttttggaagcctctaggaataaagatttcttatttcctggacctggcatatagttttagtaaaggaaatgaattattctagatcccaaccaattgtcttcaatcaaataactccctgacagaaatgaggcaaaattttaatcactaatttaacctctgcaataaaattcctaagaaagaattttgtcaaaggcagagaaaaaaatctacagtatcaacactgaatatacaaagtgtactaaatgtttttaaatcaggaagtatgcatctttttatctttggtagtttttttttttaattaacaaaacttcaccatcaagactccactcaaattattgtaggttatcctagaagtttgagaaatacaaatgggataatatagaaaagattataaagtttgtattccatgagattttgcaatttactcttcattgatatagaaacaagtattgaaatctctaagctattcaagatagtaatatgtagtgtatttgggaaagtgaaattacagcacacaagcattatctcagtttaaaaagtaggtgtaggtggtgtgttgcatagcttaatgtttgtcttctgaagaaatgcatttagttcccattctttcttgataacctctatgttatcatatctaattctttgtgataaaatgcactctgttttagtttcatgaaccacagtcaattttgttttcctttgcaaacaaagaacgaaaagatcaaatctctctctgtgctagactgtggatctcttcctagcttgggtggccatcccaaagtcatttttgcatcttcctctcccactggcctgaaagagtcaactggaacccgttcaatgctgtttgtattcatcaacacttaatgtatcaggaggattttccaccttctttcctttaaaatattttattatacctaaatgagtatcttagtctgctcaggctgctataacaaaacaccacaaagtggataacctgtaaacaacagaaacttctttctcactgctctggaagctggaaagtcccagatcagtgtgccagcagattcagtgtctggtgaggatgtgcttcctcatagacagccctccctcacatggtgaagggagaagggatctctctcaagactcttttgtaagggtactaactgcctttatgaggacttcatccctatgacctaaccacctcccgaagactcccatctcctaaaaccagcgactctggagtgaggatttccacatatgaattttggggggacataaacatttagatcatagcaatgactatatagtaaaattctattaattcaggtttattgggagaaaggtggtttgaatttagtgggaaggacttcgttgctgtagatatctaaattcaaatcaccttattaagaattgtcaatacaactatttcactaccagtctcttattagaaatgaaacatttaatactccagagaaaatagtttctccagactttttttttttttttgagacagagtcttgctgtgtcacccaggctggagtgcagtggtgcaatctcggctcactgcaagctccacctcccgggttcacaccattctcctgcctcagcctcctgagtagctgggactacaggcgcccaccaccatgcccagctaattttttgtatttttagtagagacagggtttcaccctgttagccaggatggcctcgatctcctgacctcgtgatccgcccacctcggcctcccaaagcgctgggattacaggcgtgagccaccgcgcccagccctctccagacattatttaaatggataccacttttaaatatttaactgttctatcttttttgacatattaaatttgcattttgacttctaaaaatgtaaaatgtgcatcaaaattatacatttttggtttaaatatttgaatcataaatggccaatattgaaaatatgttttttcaatatattgaacatttattcaatatattcctgttctaagaatctgtatagtgatgggttaatacaagtaaatggaagcattagattgtgatctttaactaaacaggcactttttgtcattgtaattgccttgggactaatgtatgtgactgttacatttgtttccaacatgattttatttatttattatttgtatttattttttttccagctcttggttgtgcttagacttgtaataataactctgatttcaccttatctagaaaagtttcaccttatctatctagtttcactctgtcacccagactggagtgcagtggcacaattaggattcactgcggcctcaacctccatgggctcaggtgagcctcccatctcagcctccttggtagctgggactacatacgtgtgccaccatgcccagctatttttttctattttgtaattttttgtagacacagggttttgccatgttgcccaggctgggctcgaactcctgggttcgggcattctgcctgcctcggcccccacaaagttctgggattacaggcatgacccaccatacctggcctcaacatgattttatacctatttgaaaagacatgctatatgtcatagatattcagttaaaataaattagccgggcatggtgttgggcacctgtagtcccacctactcggaggctgaggcaggagaatcgcctgaacccgggaggcggagcttgcagtgagccaagattgtgccactgcactccagcctgggtgacacagcaagactctgtctcaaataataataataataaaatagttcagttgattacagctaattgaatcacacacacaaccacaaaactctattcaagtaatattcagtacaaaactaatggatacaaaaaggagaagatttagtattaagggtcagatagcactgccttgatctttccgagaaattataattattggcaactgaacttctaggtgttaattagtgtgacagaaaaatcaagccctttctcaccttactgtgactaattatatagttatatgagttttaatctcttcccattcaatctcaaaatggtgcctcaaacatgtatttcctcagaagcttaaggataaggcagatatagttttggttgtaacttttttttttttttgagacagagtctcactctgttgcccaggctggagtgcagtggcatgatctctgctcactgcaagctgcgcctcctgggttcacgccattctcctgcctcagcctcctgagtagctgggactacaggcgcccgccaccacaccctgctaatttttttgtattttcagtagagacggggtttcactgtgttagccaggatggtctcgatctcctgaccccgtgatccgcccacctcggcctcccaaagtgctgggattacaggcatgagccaccgcgtccggcctgtaactttcaataaactatttatttcactgaattctaggcttctgagggtgtatactgatatgtgggcagtggaaaaatacatataaaaattaaaatgttttatgttcataagatcataagaatgttattactctggtgatactgaagtccaatgaatctgaaatagcattcttaatcttatgctgacggtgtcttgttagctttgtcatctgtgtaggcaaggaggaacctcacggtcagtcacttcagcaaatctgagctttacgtgggtgatagtttcaggagtagaaaggaatcatgtcatttttttcactcttttccaaacctttatggtgatgtaatattgaacgaatttacagacactaatgattttatgtctgtcaatcctatctcacaaatatttgtctgctacatgatacccattcttaatgataacaccagcaagatacctaaccttcagaaatactctcaagctttgctactgggattgtatattagtaatatcatttttaaaaactgtcagtatctaataaggttgaacatatataattcatccttttctttcctaggtatatttccaacagaaacatatacaatatacacgagtatgttcatagtagcactattggtaataggccaaaatttttaactacctaaaggtccatcaacagtagaataaattgtgatacattcacataatggaataacttacagcaataaaaataaatgagttccgatttcacacaacaatatgagtgactctcacaaacataatattatgtgaaagaagccagaaaaaaagagtatataatatatgatttcatttacctaaatttccaaaacagtaaaattaatcaatattattagaaatcagaatagtacttacctttgctgagaagaggtggaatggaaacagaagagaagagcttctggcatgttgatctaatgttctatttctgaatctggttggtagttatgtgtgtatgttcagtttgtgacaatttatcgatatatatatacacacacacacacacacacacacacacacacacatatatatgatagattgaactcaaatatttaatttgtgcttatattagtttcccagggctgctgtaacaaattaccacaagctgggtggcttgaaacaacagaaatttattccctcacagtgctgatggccagaagtctgaaataaaagttttatcagggttgtttaattctggaggcttgtggagagaatctgttctatgcctgtattcctagcgtctagtgtctgtcagcaatctttgttattcattggcttatagatgtatcactccaatctttgccaccttttccacatgatcttccttcctgtgttctcttctcttctgtctctgataaggccactggccactggttttacccagcacccatctgggtaattgagatttttaacttaattatatccacaagggcgcttttttccaaataaggtcacattcacaggttcctgggtgacatgccattttgggggctactaattaatccactacagtgttccttccccaaaccccacagaaatcatgatagcggaaatataaaaatattgtacagacaagaagatttaagaagggttaaatacagatgagataggttcaagattttgaaagatcgtgagtcgatattacttgattcagcaaaatgcaggaattaaagttagttgccagtgcgaagcaactcaggcagtctcaggatctggagatacgaggtacttctggattcaggggtaaaggctggggcttaacatagtaaatttggttaacaatccacttaagaaagttaaagtcttagatcaatgtccccactctgggcatcaagtgaatataaccatcccatattgaggcagaaagaaaagataattacagctttataaaaaaaataaaacagagaggagtcaaagtggctctggactagtggacatgaagaattgctgagggagggtgagttactgtactcaaacaaggaagtaaagaagcagcctataattttaatggtgtagactccctcctaccacccctctatgcttatctaccaggaccctggcagttgggctcataccctagtcacgagattcttctcagcagaaaacactccaacccaagagaaaagacctgcctttggtgtgggtgtggtgatggtggtggtggcagggggtgtctccaaatgaaaatatcaaaacttccctgatctcataccctggagttcaattagcaatcaccatccttctgcacacaaagcttccattcagcttttcattacctcacttataaatagcagtggtcagccaagagttacaagatatttgaggaaagcttgcattgtaaaagacagagattttttaaaaatgagtgtacagataaaacgaactattagaaaataaaggctattcagggagatgaaaacttcaaaaaattacaatgaatattctcaaatacattaaagaagcactttataacatccagaatgctataaaaatgaacattgagggaactaataagaactcttgagagaataaaatattatggcataaatcccccagaaggtagaataaattatcaaagagatgacaagatttttttcaaaggaggattgatacaggaggtctggttaataggaattttgaatacctgaaaaaaatgagagaaatagagaagggggaaattatcaaataagtgatgcaagaaaaatttatttaattaataagcctggttttccatgtttaaagggttcaacaggtgaccagcaaaaggaaattaaggtaactgacatcaaggcatagtggccagaaatgttaggacaccaagggtaaagattctaaaaacttttccaaaggtgttagaggaaggtgatatacaatatgacacaaatcagagtaccactgacttctcaggagcaacacttgaagcaaaaatcaataaagtaatgtcttcaaagtttcgagagacaattactaattgcttttcacttataattctaaatctgaaagatcagatagatagaaattttcaggccaacaagttctcaaaaaacataactacaatgtatcatttcacaagaaagttctggaggttatatgttaccaaaatgagtgaataaactggcaaagaagagttgagaaccagacagcagggaacacattgataaaaaaatatattaattaaagagaaaacctcttgagagaaatgtgtggattataagcaacagagaaaacagaaacagaaatatatagaagaaaatcattttcagtgaattcaatcattagtaaatttagatgttaaatatgtaaatggatgcttccggaaaaaaaaaaaaacccaaaaactaaagatctctaaacaacttgctatatgtttctgccttttctatttctttgattgatatgccctttctccatcctcattgtaggtacgctagtcattcaaagactcatcttaaaatgtaatcccttcaaaaatataggaagatatccatatgtccttggttaaggagagctttcttagcatagacccaaaatacagcaataaaaatagaaattaaaatctgaccacattataatgttagtcttataacaaagtctaaagcaaaaaaaaaccataaacatgtttaagaggtaaatgacagagtgaaaaattaaatttccagtggataatatgacaaaaaatggtatgtaaaatctgtaaagttttctaagtcaacaggaaagatatcaaacgcaataaaataaactcgtgcaaaaaatggtcaaagttatagtattataattcacggaagataaaatccaattatgagaggatgttcaacttctacttttatcagtaaacaacaacttaaaacaatagtgagttcctatttttcgcccatcagattgacttttaaaatctgtttatcacgtgttagggaacatataaggaacgttttaatctcagatattgccagtaagagtatacatttgcacaaccatttttggaactatttagcaacagctcataaaattgaaaatctggatgccttattacaacattaatcatataatttattattcattctaggacacctttgaacatgaaagagagcactattaaaatgtatgccagaacaaaggcataaactggagttatcccaggccaatctcctatactgtcaccctctgtatgatccacttagtgtatagaacctagttagcttcttgtccatgtgtactatgtgtatgtaaagctactctttgtcacatagtttataacagcaaaaaaaattaggaacaggctgggcactgtggctcacgcctgtaatcccagcactttgggaggccgaggtgggtggatcacctgaggtcaggagttcgagaccagcctggccaacatggagaaaccccgtctctactaaaaatacaaaattagccggtggtacaaatacaaaatacaggtggcacatgcctgtaatacagctactcgggaggctgaggcaggagaatcgcttgaacccaggaggcagaggttgcggtgagctgagatggagccattgcacttcagcctgggcaacaagagggaaactccgtctcaaaaaaaaaaaaaaaaatttaggaacagtctgtcaaaaggaaactcaatagataaaatagataacacagaatagtaaataataaggaaaacagatgaactagatttctctgtatatcagtaccaatagacatccagtacacacacttaggtataaatagaaaattcaaaattccagaatattcattaacatatataacattatatatctcttatgttatatatataacatatatatatatatatatacacatcaaacattacatatgatgttaattgatgtgagtgcaagtataaaaatggaatggaagaatatacctccaatttataacagtggttgtctctggcaatttagaaaagatctggatgtggtttaaggagaattaagctatattaataacgtttaatttctttaaaaataatctgaagcaaatatgacagattttaaagttgatatatatgaattggagaaggtatatatgtatgttttaaatttttttgtatagtgattttttttctcaaagtaaaaacaaaataaatcctctttcacaaagctttccttgatctctttaagccaaacatctctgtgtgtcctctgtatgcctctaacactatagctctcataagaattaagctttctgcctatggagtttatctctcccattacattggaaaagcttaattgaaaaagcagtatctcatccccttttgtatctctccacagcacctgatcagatatctgttgcatagtaaatacccaataagattttattaaacacaatagcaaaggaatagaatggtgtacatagaaacacttgctctttttaggcaactctagaaaaatgttaaatttttcattttttcatgcttttcttcacacagcggacctatgtttgttttacacctatgttatgtttctattgacatacttttagaatgaatacttagaaaatatagtgctttgtaataatatacatggtcctagcatattggagatacaccagacaatctaattgctgaaccaaatgtaggctagcttggtgatcaaagggaattgttttgatttctcctgtctcatatatatctgttatttgtcctaatgctgagctctagactgctgaatgaacggtgacatttttcttggttactccattgtgccacctcacctccatttgtcactctagtaatgttaacatctgctgtcaacaccaattaacttttttttttttttttttttgagatggagtttcactccatcgcgtaggctggagtgcagtggcacaatctcggctcactgcaacccccgcctcccgggttcaagcgattctcctgcctcagcaattaacatttagtaaacaccttctgggtccatagtagaatgtcagttacttgctgctcatttaaagactagttgttaagcaaaacttgaatacagtatggcatttgctttgagtttattttttttaatttcaagtttcatggcttttgtttttccattctcataaataaaacatatgcttttattccttgacagttatcagagtttgttcagttgaacaatgcccaacttgcaaatgaatacttttgcaaatacatatggtggatatacaaatacatatgtgaattcatttggctctaatgtgaacttattgaatgtgctatgtcgagttatcttttatcaaaagaactgttagtaactgaggacatcaaaaaattatgcttgctcatacatacataaatgctatatttaggttttaatgctagcttttaaaatgtcttctttgcccgctacttacactaacaggatttccttgttcttgaaagtgaaatatatttttaagaacaggttttaaggccaggcgcggtggctcacgcctgtaatcccagcactttgggaggctgagacgggtagatcacaaggtcaggagatcgagaccatcctggctaacagggtgaaaccccgtctctactaaaaatacgaaacattagctgggcgtggtggtgggcgcctgtagtcccagctactcggtaggctgaggcaggagaatggcgtgaacccaggaggcggagcttgcagtgagccgagatcgggccattgcactccagcatgggcgacaaagcgagactccgtctcaaaaaaaaaaaaaaaacaggttttaaaaaaatttttagatttgttttttttgtttgtttgtttccagttttctctgctgtttcagacttaggactagacatgcctggctctaattgtcctcttagattgttatccagctttcctttgagacaatattttgcacaaagtgtgttctcttagctggttgattccagtgatggctggaatctatgcatagtgtggtgtttcacagttagacctgactagttatcctggcactttgaaacagttggtttcaggtacccttccacacatacatacaaaagatgtgctgatgatagcactgacttttcagagtggtcttttcatcataattaaaagttttttttttttttttttttttaaagcctgaatacacaatctgtgcatggctttgatgattctgtagttaagaagggcaggaacagccttggggaacacttactaacttggaatcatgaagaaagtcacaagcacctacagatgagcagaaaagcaagattatttcattcattttacgtccacaataccacagggactggctggtcagttacttgcgcatgttgtcaaagctaacctttaaagacagttcatctggctaaaaatcaaataccttatacccagagtattagatatgcatcagcgggtggccagggtcttaaggcaggaagtatattataggtggcctggtattttgcaggctcttctgagccagaagcattttttatcagaaaggttttggaaattatgctcagcccctggcatctttttggtcctctcttgatcgctagtccagctgttgaatgaaaagaaatgaagctgaagagacatcactgtggctacagctggtgttacggaggttggtgtcatgctacaagataacacacacatcatttttactcatgtggaaggctgccttgctgtgcatttccacggctgtcagaaagattgattcctgaaatactttgaaaaaatgctaagtactagctactttgggtgtttacccaggggcaccacagctgcctggcattgtagtatggcagctgaacagtaatcactgctatttctctgatttgtttgtgtctttgtcagcatctgagaggagggaggttcaatcccagagtggggccctcactccacagtgatctcattcagcccatggctttaaatactctctgcaatgctaatgactcccaaatttatgtctgtggccctgatgtcatccctgcatcccagactcatagatccggctgcctattaaatagcactgctttgatgtctatgaggtatctgaaatttaacataagcaaaaccaaatttctgatctgtccacccatatatgacccaacttatcatcccaccatcttcccacaggagtaaatggcaactccattcttgtggttgctccagccaaagccttgtgatcatccttgacccctcccttactttgtatcccacatcccaaggtatccaccttgaaagtggattcagtacatgaacacctctctactgctgctgtcttaatccaaaccaatgacaaatctcatctggacgattgtaattgcctcctaacatgtcaacctgcttccttttcccaatagtgtactttctcatggcagtaaaagggaatccttaaacacaaattacattacattatcttctgcttagaaatcaccagcggccagatgcagtggctcacacctgtaattccagcactttgggaggccaaggcaggaggattgcttgagcacaggattttgagatgagcctgggtcacaaagtgagaaccccatctcttaaaaaaaaaaaaattaaaaattagctaggcatggtggtacgcatctgtagtcccagctaatttggaggctgaggtggaagcatcagctgaacccaggagatcaaggctacagtgagtcacgatcgcgccactgcgctccagcctgggcaacagagtgagaccctgtctcaaaataaacaaacaaacaaacaaacaaacaaacaaacaaaggaaatcactagtgaatttcaatcccaaggttcaaaccacatctgtaaaaccataagcgatcagactgtctcatacttgtttgcttatccttctgttatttccttagccgatttccttaactcattcacctgcgtattcaatggccttttcatttctcttcgaatagtttccacctaagtgcctttgaacttgatcatctctatgactggaatgctcttctcccaggtgtttacatggcctggttcctcttttcatttaaagcccatgcccactcaaaggccatatctccttgtcagtaagatctttcctcaccagcctttataaaatatagcactgctcccaatggtctcttattctgctatattttcttaatggactttataatcctgatgtcttttcccactgagtgaaggctttgtttcgttcactgccagttctccagcaccaagaacagtgcctagtgcacaaagggctttgataagcatctgtggaaagtgcaaacattcacctgactcttctttctatctctatctccaccagctgtaaaactgtgcttagaatccctgaacattttattttaatgaaattacctctgcaatatctttagctcttcagtggaaaaatctttcaaaatccagggtctcatggagctcatgtctccatctctgacttaaatagtccatgaaacacatgattctggaaactgagattgtgaaaagcacatcttgctgcaccctccagtctttgtgtggtctctagcacttggtgccatagtgacagtgtctgggtagaacagatgtttttagtgatctgaaaatcactataaagaaaaggcatttcctacatcttggagagaaacttgaaagttcacaaacatgttaagtctaacaatttcttagacttgccatttgcttttatccactttcaggataaccgtaatgtttgcaactcatcttctgtgtctcccccaaataattcatgtttccttttcctccttgtcttatatttcaatgagtgagaagtgaggcatcttactcttattttgtattaaagccctgcgctaatatttctaacgttctcttttacgatttagtgagatttcagaagtgagagggatagttttgttctgttttccatgagttttctagttctttgagaggaagagggaccacgaaattcaatattagtgtttgtcataatactcagcaaaagccttgcctgtggtatacactcaataatgtctgttcatttgggttttaacttttttcaaatctcctcagtgttataattacctgtccttttcattagaaatccaaacctgattagcaattgtttttccagagaataagccacttgccttctctaatagtattggattggatatcaactaaggcatagcttcccaacggatgtgcagtggcacatgactgtactccacatggatttcaaatgtgctcagacaatgattcctgtaagctctcaggggcagctggaggctctagaccaatcatttctaaccacaagattgtgtattccagggtgctctacaaaaattataatttccattatgtgctacggcatgagaaatgttgagagttagtctagtccagtactgcctaactaaactatctgtgcagtcatggaaatgttctagatcttccttccaataaggtaaccacagtgcagctggaatttaaactctaaactatataaactattaggaaccaaagatgaaaaataagcacaattcagcaatttatcagactcgacaaatattaatttgaggtgttaacaacccacagtggtaccagcaggcagaaattaaattaatatatcactaacttgagaataaaggcatcaaaggaaacctcattttttaatgtggctaacattgttggatattagctggctgatgctagctatgtacgctttttctcttgttgtcttctttttgtttgacgatgtggcaaatgacagtgctgttgcctgaaaatggcttcaaagtcacacttgtatgtcttactgtattgggtttaggtgaattctggtgtctgtgttgttcttctaatggggcctggagcaatctaataatttgcatttgggtcctatagaccatatggtgtttatcacccacttctccatcttagatgatctgccagtcattgatgaggtgaaagctgtgtttggcagtgctttcatgctaggttaatcattgtggaattagctattgtttatagcactttttaatccaagcaagagtattctggagtctgtacatctgtaagtcaaaatttacaacctaacgtcgatttacaatgaggaaaagcaagttagataacatattgcatattcataaattactcctaagagataattagtacctggcctccacttcatgattcctctgtttgttagttcttatgatacaatggttgtggagatgcctatttgatcgtatttctcaaggagactctgatccagtgtgttccactgcctcattaacctctgccctcaaaatacaccaagtcaacctctgtttctttattcatgctgctccctctttctggaatggcccatcccacctttcttctcaggtacattttagccttacttatggaggcattgaaatctttaatattagtattaatgtacactagcatttatggaacacatttttttgtgtgtgtcaggcgtaatacccgccaccttaactaggtatttcacttaaacgtcacaacaggacttcaagatatattttttcaagatatatatgtttaatacctatctcataaatgaggaatctgagcttcaaatatgtgaagcaattttcataaaacaattttgtaatgaagtagagtaaggttttaagctaggacttcctgactctaaagtctttgttctttccattgcaaataaagaagacaaagaagtctattaaaggtatctaatgaaggaatctgttctccattaaccttgtactcacttgagacacagttgaaacacagtaaaacagctttgtagattgcttgcttggcttattgatttccaaatcctgttttctttttgctaccatcttacttcctgtgtcatagtggaaaccaacaaaagaattaattctttgtcaagtgtgtgaggaagagcatggtggaccagaagtcttggtccttcctgggcaaacagatacattgtcttctgcacctatacatgtccctcattcgtgaatttcgccctctgatttatatcctatctgttctatcttttaactaagaactgtgaaatcacccatatccaggactacatggctaatctttttattaaacattgtctatcatgtgtttttttttttgttttgttttcttttgtttttgtttttgagacacgtgctcactctgtcaaccaggctggagtgccgtggcatgatctcggttcactgcaacctccgcctcccatgttcaagtgattctcctgcctcagcctcctgagtagctgggactacaggcatgcgccaccttgcctggctaatttttgtatttttagtagagatgggatttcaccatggcagccaggctggtctcaaactgctgacctcaagcaatccttctgccttggcttccataaatgcagtgattacaggcaagagccaccacgcccagcctctgtcgtatgttgttgaattcttggtcatgcctattcaatcagagtgtaaattgcttgtgtgtagtatcttatttggtcttgccctatggcaccagctcaaatgctaggctaatcactggcagtttttacatattgttgattatgtgaatgattatcttcacattataactagacaaaaagagaagtaaaacaattagatattttccccagagatgagtgaaataactgaataaactaactcttgttcataaatttcttaaagaaggatgacaaatttatcttgtaaacatacaaataactggtacctaatatttttcagtggggtggagggtggagtaggatatcagaataggactctccagccattgtctccctgaagaaactttaatttgaacaactatccatgcatgaaaacatcttcaccagggctaaggaaatcaggtgagcaatcaaagcactaggttatagtgtaatgctaagaaaagacgcatcaaagagggcaagaaaaacagttttattacctctgtcacccctccacaaacccagtaagcatagcatggaaagagattctgtctgcttgggggaaagagagggaagtaagcataagactttgcctgctacaatgaaatctagcatcagtcagaattccatgaccactgactccaggctaaaacctatgtacggagcctttagaaccaacttggcacccgagaggagcctgtagcccctatgaaatggaatcaagttttggtctgcattgtggccagctgactacagtggccttgagctgtgaataacccacagtgataggcaggccttagtggctgtgggtttcaggcatgccccagggctgtgctagcctcagtggccacgggctttaggcacactccaatgctgcaccaacattggtgaccataggattctagccctatgccaagctcagcagccgcaaatccaatcttagtacagcataatttgcagtggtctagggcttagggaattccctagcactgcaatgactgtagtgctcaagggcataggaaccataccggacaaccttttcaaaatgtctggacaggcttactgctgaaagatgttttcagacaaaaccagattgtgaagggcctacttgttcagtgcacagacattgattcatgactacaaggaccaaaaataattaggaaaacatgacatcataaaatagacaaaataaggtgccattgactgaccttaaagagatggagatatatgaactacataacagaaaattcaaaatacctcctttaagggagatctacaaatgtcaagaaaataaagagaaataataaatttcaaggagtaaaacaataagtgaccagtacaataaatttaacagcaaaattgaaatgataataataaaatattcaacagaaaccctggaactgaaagatataaggaatgaaataataaatgcaacagagagaatcaacaaaagtattcatcaagaagaagaatctgtcacttgagaacaacttatttgaaaatatacggtaagatgagaaaaagaaaaaagaataaaatggaatgaagaaagcttactttggggatagtatcaaaaagaaaaagcaaattatgagtcactgacatttaagaggaaacaaaggaatataaagctatagaaagcttatttaaagaaagaaaagcagaaaactgtcaaatctgcagaaagatataaatatccagttacaggaaggtcaaaggtctccaatcagattcagtctaatcagatttaaataaaagccaagtcatattataattaactgttaaagatcaaagacaaagagaagattatatacacagcaagaaaaaaaaaaagaaaataaagggagtttcagtacacttagcagtagcagcacatttctcagcagaaaccttacagaccagaagagagtgggatattttcaaagtgattaaggaaaaacatgcccaccaaaaataccgtaccaagaaaagctgtccttcagaaatgaaggagagataaagacttcccaggcaaacaaaagtcaagggagttcttcaccaccagacctgtcttacaagaaatgccaaaggaacttcttcaagctgaaagaaaagaatgctagtgagtaacacaaaaacatttgaaggtataaaactcactggtacaagtaagtacaaagtcaaattaagaatactctaggccgagcgtggtggctcacacctgtaatcccagcactttgggaggctgaggtgggtggatcacctgaggtcaggagttcaagaccagccaggccaacatggcgaaacctcgtctctaccgaaaatacaaaaagtagctgggcgtggtggcacgcgactgtagtcccagctacttgggaggctgaggcaggagaattgcttgaacatgggaagcggaggttgcagtgagcgagatcatgccactgcactccagcctggtgacagagtgagactctgcctcaaaaaaaaaaaaaaaaaaatactctaatacggtaatgatggcgtgtaaattccttatatctttagtaagaaggttaaaatataaaaatactaaaaataataactacactaacttattatggtacatgtaatataaaaagatgtaaattgtgacatcaaaaattcaaaatatgagtgtgtgtggagttaaagtgaacaatttttttgtgtgtggtcgaagttaaattgttatcaatttaaaataacttataaaatgtttttgtaagcctcatggtaaccacaaagcaaaaaacttataatagatacactaaatgtaaaaagcaaggaatcaaaccatagtactaaagcaaatcacttaaccacaaaggtagacagtaaaagagaaataaattttaaaagcatttacaaaacagctcgaaaacagtgaaaataatggcagtagtaagtccttacctatcagtaactactgtgaattaaattgattaaattatccagtcaaagatatagagtggctgaatggattaaaaaacaagactcttctatatggtacctataaaaaaattcactttactggtaaggacacacagagactgaaagtgaaagtatgaaaaagatattgcatgtaaatagaaataaaaaacaataggagtagctatacttaaatcagataaaatagactttaagtcaaaagctatgaaaagagacaaagtcattatataatgataaaggggccaattcagcaagaggatgtaatgattatagacatatatgtacatcacattggagcacctaaatatacaaagaaaatagtaatagatctgaaaggagagaaagactgcaatacagtaacagtaggggcattcaacaacccactttcagcaatggaaagattatccaaacagaaaaatcattgaattgaaactgtactctagaccaagtggacctaacagacatatacagaacattccatccaacggatgcagaatacagatccttctcaactgcccatggagcatgattcaggatgggtcccatgttagaccacaaaacaggtgttatccagctttagaagactgaagtaatatcaagtatcttttcagaccatgatggtataaaactaggaataaataacaggaggaactttggaaaattcacaaatgcatgaaaattaaacaacatgcccctgaacaagcaattgatcaataaagaagttaaaaggaaaatttaaattttttaagacaaataaaaatggaaatacaacataccaaaagctatgagatatagcaaaaggagttctaataggaaagtttataacaataaatgcctatatcaaaaaagagaaaaatcttaaatagcctaaggttgcactgcaaggaactagaaaaacaagtagaaactcaacccaaaattagtagaaggaagggaataataaagatcagagcagaaaagagtaaaatggagatcagaaaaacaatacaagagatgaatgaagcaaaggctttttgaagacaaaatcaacaaacctttaactagattaagaagagagaatattcaaataaataaaatcagagatgaagaaagagacattacaacctagactgaagaaatgcaaaggatcataagagagtattatgaacaattatatgccaacaaattagataatctaggagaaatgaatatattcctggacaaatacaacctaccaacattgaattatgaagaaatagaaaacctgaacagaccaataacaagaaaattgaatcagtaatagaaagtctcccatcaaatagaagcccaggctttactgctgaattctaccaaatatttaaggaagtaataccaattcttctcaagctattacaaaaaattggagaggagggaatacctcctaaatcattctgtgaggccagcattacactgataccaaaaacagataaggacacaacaacaacagaaaactacaggccaatttccttgatgtttacacatgcaaaaattctcaacaaaataggagaaaaccaaattcaacaacacataaagatattatttacatgatcaattgagattcatcaaatggatacaaggatagttcgcatacacaaatcaataaacatgatacatcacattaacagaaggaaggataaagaccacataatcatttcaatagttgcagaaaaagcatttaataaaattcagtatcctttcaagataaaaactctcaacaaattaggtatagaaattaggtatagaaacagtgcacctcatgaccataaagaccatatgtgacaaacctacagctaacatcatgctgaatggggaaaagttgtaagcttttcctcaaagatctggaacaagatatggatgtccactttcactacttctattcaacatagtactagaaatcctagccagagcaattaggcaagggaaagaaataaagggtatccaaatggaaaaggaagatactaaacttttcatgtttgcagagacatgatcttatatatatagaaaaccctgaagagtccaccaaaaaactttagaactaataaacaagttcagtaaagtggcaagatataaaatcagcatataataattagtaacatttctatacactaacagcaaactatctgaaaaagaaatattattttaaaatctttatttctagtagctacaaaaatgtaaaatacctatgaatacatttaaccaagagggaaaaccatctctacactgaaaactgtagccgttttacattttacagaatcttgatgaaataaactgaagaagacacagataaatgaagaatatttgtattcacaaactggaagaataaatactgttacaatgtccatactactcaaagtgatctacagagtcaatgcaatctctatcaaaatacccatgacactttccacagaaatagaacaaagaatccaataggttttataaactgcaaaagacacaaaagagccaatgcaatcttgagcaaaaagaacaatgctggaggcatcacactacctgacttcaaaatgtactgtgatgcaatagtaaccaaaatagcatgatactggcataaaaacatagaccaatgaagcagaatgaagagcccagaaataaatctacacatttacagctaactcattttttttttttcaaaaactgccaagaatacacaatggggaaaaagcagtctcttcaataaatggttttgggaaaactggatagccacatgcagaaaaatgaaattagactattatatctcactctatacaaaaatcaattcaaaatggattaaagacaaaggtaagacccacaagtgtaaaactattagaagagaacatagggggaaaactccatgacactgttttgggcaatgattttttggatgtgacttcaaaaacagaggcaacaagagcaaaaaaaatagacaaatggaattttatcaaactaagaagcttctgcacagcaaaagaaaaaatcaatagaataaaagcagcctatagaatgaaagaaaatatttgcaaactatacatctgataagggattaatatacaaaatatataaggaattcaaacaactcaatagaaaaaagtcaaataacccattaaaaatgggcaatagacaggtatagacatttctcaaaagaaaacatacaaatagccaacaggtacgtcaaaaaatgttcaccatcactaatcatcagggaaatgcaaatcatgaccacagtgagctatcacctcactcctattagaatggctattgtcaaaaaaaaaaaaagataagttttggttagattgtggagaaaaggaaacccttgtgcactattggtgagaatgtgaattagtgcagccattatggagacagtatggaggttcttaaacaaattaaaaatagagccataatatgatccagtaattccactcctcggtatatatccaaagaaaacgaagtgagtatgtcagaaacatatgcacttctatgtatattgcagcattattcaccatagccaaagtatggaatcaacctaagcatccatcaatggataaatggataaataaaatgtatatagatacacaatgaaatactgtttagccaaaaaaaaataagaaatcttgtcatttgcaacaacatagatgaatctggaaggcataagtttaagtgaaagatcccaggcacaatatgacaagtactacatgatcacactgacgtatggaatctaaaaaactcatctcaaaaaggtagaactttgagtgatggataccagaggctggggtggctgggatgggagtgttggggaaatgttaggcaaaggatatataattatagttagatagaaggaataggttcaagtgatctattgtgcagcatgatgactatcattgatgacagtacattgtattcttgacaaatgcagagactggatgttaggtgctttcaccacaaaaatgacaactacgtgaggtaatgcacttgttgattagttagatttaaccattctacaatggatatatacttcaaaatatcatgttgtacatgatagatacatacaatgttatctgtcaatttaatttgaaaaagaaagaatgagaaaagatacttttcaaagagtattaatagtcatttttctgaattcctgtagtgtattttcaagatgaataagttttctaaagtaactgaagcatatctcattagccatcaaaaattatttttaatggcagtttttaatgtagatcttcagaaaaaaagcacacaattactgccttttaaaatagaatgcatgaaatacaattaaatctttccttgactagtcaaatcaaaaaatttttttggaatatcttctgttttacctgttatgaaaaacactaaaatccagggaaataaaagtttagaaatttattcttagtgcgtttacaatctcaatggaaagttaaatgtgtagaaggaaaagttacaatctggcctcttaaaggcgggacagaggtaaacagattgtgtttaagagtcccagaattagtaaagtttaacctacaagttgacatctgtggtagtcatggaaggatgggttaggatttaagaaggagggatacggaaggatgggttaggatttaaggagggatacagcattctagaagaaaaggaggggcattctaaatgattccaagaaagtggtaaattggggaaatggtaaaatgttcagtgtgcttgattagtagcagcttgagaatagttccagactttacaggagcatgaaaaaaattcaattcggatcacattactttcttgcttacaaaccattgttctgctgttactgagtaaaagtcttagcttgttaaaatgcaaaaaatgtgagcaagcccagccaagatgagcaaagccacatgcttgacctgcagttaaccacagatacataagggagtaaaacaaagatcattcaagcctggccctgatcagttatcttggagacctatgaccaataataagtgaccattattttaagctactaagatttgggatattttgtaactcagtagtatttcactgatgaattgtattagtgcttttctattcttctaccctaaagtaaaaatgtctttgctacttatcacattcaaagaaatgtggagctgtaatagaaacaaattttgccaggcaaataggaccatggtattgctttgggctggcatagatgcaattccatgtaattccatttcttgttataaacttggctctaactgtacaatgtatacttcagtatatggacagatgtagatgtagatactgtgtataggtatgcactatttatacctctcaaaaatttaccaaagtcttcatatccatagcactgatattttttaaattaactcttgttagtatggacaattttagctataatattcacaaacgtagagagaataacataatgaaaccctatgtacttatcaccaagctttagtaatttctaacattttgcatgtgttgttgtttgtaacaggcttttgttttgttttatttttgtttttgttttcctttcttttgacaacatgagtggtgttcaatgctactaagaacaaatttgcagatttttcctgcaatgcttgaaatgattaacctctgtttgttgccaagtaactcttgggtacgtactgatagcaaaagtaatataagaatattcacagcatagttaaatttggatagcaagtattatttaaagggtgcctgatattattgcttataggcatgtttttctttcttgtacctcttatttttggtagtaatcatgtttttaatgacttgtgatagacttgttttatgaaacaatagaaaatcaccataggacctctttagtaagcttttagagtgttgaagctacttgaaatcttctctggtgggagattattatttgctaaataattgtttgcataaactgactcctccaacagtgttagttaaatgaatcataacaattagtataaacagagaaaagtaatgatgatctaggcaagtaacttataggtgttctgtttgttgaacaaaagaatgaatggaaaattagggctcttatttatttatttatttatttatttatttatttatttattttttggctgtatccaggatagaataaataaaatgtttgttttcagtctgccttcacctatacttcttggtaagaaaggaaggatgaaaggaaatggtggattgagggaggatgagaggaagaaggaaaaaagaaaggaagtgagagaggctaattatctggaggttttttttaaaagcagtaatgccaccaaattaaagtagcttttcaatttaatgcacaatatttatattactattatattggcatttcagggtgccaagtgtaaagaggttatcttagatgcacagaatatcaaaaaaaacctgtgctatcatctcccagtgcagcctaatcattgacagaggtcaagaaagttaaagcaagtgctgaagttgaatatattaatatacaaaaatatagtatttgtattagtctgttctcatgctgctaataaagacacacccaagactgggtaatttataaagaaaaagagatttaatggactcacaattccaaatggctcaggaggcctcacaatcatggcagaaggcaaaggagaagcaaagtaacatcttacatggtagcaggcaagaaagcttgtgtagaggaactcccatttataaaaccagtagatgtcgtgagacttattcaccatcacaagaacagcatgggaaagacctgcccccatgattcaattgcctcccactgggtccctcctcccacgacatgtgggaattatgggagctacaattcaagatgagatttggtgggggacacagccaaaccatatcagtatcattacccataaagacacagatcaccaatgaaatttaattcatctagagaaatgcattgtagtagtactaaagttatttggttaactttatgttcctatattttatgcaaatacgaatttttttataagatttgggctgttataaaatgtcattctaaagaacatctctaatattttatgtaattactacaaaaattaaaaatagttttatatttataaaccttgaatttcagtggaggccatgcttattaaaattcactttctttttggttacagcattaaaggggcttctagaatgcttaccttttttcagtccactatcataatgagagcctcaaattgtatgtcatcattgggtcatgtaatcattaaagagttctacttatgagagccaataacagacatgaccctttcttctagtctgttcaggcaagcagatcaaacctcttcaaatcctacagtaaaagtttcactattgtcaaatatagcttagtcctaatgaagtacattaaatttacacaaaactttctgtccttgtttccaaacttcatctaaataagtttctcccacctccctcccacagcattgctcataatcaggaaaaatatggtgtctagtagaaaccatgttggaaaacacaaatgtgaaaaagcaatctacaggctgggcctggtgactcttgcctgtaatcccagcacttttggaggccgaggtgggtggatcacctgaggacaggagttcgagaccagcctggccaacatggcgaaaccaggtctctactaaaaatgcaaaagttatccaggcgtggtggtgggcgcctgtagtcccagctactcaggaggctgaggcaggagaattgcttgaacccgggagacggaggttgcagttagctgagatcatgccactgcactccagcgtgggtgacagtctccaaaaaaaaaaaaaaaaaaaaaaaagcaaactaccgaaatagaaaatatttgaagtatgtgaccattaaaattagaagaggtaggtttgaattctggcttctgtcctcactggacatttgtttttgaagtttctatgtctgttcctttgtagcaaactgacagttttaaataaagtaacgtaaccgcacaccccaaaacataagtgttaattttccctactgcacaccccaaaccacacaccccaaaacatgttaattttccctatgcatatgcttacttgtgatcttatatttatgttcttgtatcttataagccttaaatttatgctgagagttctagccaacaacacatctacttaatgttttgtcagtgaaattaagcagagggtgttatgtcaatatttaatgatagattgatatattgcatgggctactttgtttttaatccttggccagggccgttaaatatttattgacagttaccaaaaaaaatggtttttaggctaacttctttttgtaaatatatgttcagtaattgccaataacttccatactaactgaagtatattagtatataggaagctgttgctatgaaataactgtaatatttcaaaaactaaatgttttttatttcaatagttttgggggaacaggtggtgtttggttacatgggtatggtctttagtggtgatttctgagattttggtgcacccatcacccgagcagtgtatactgaacccaatgtgtagtctttaatcccgcactcccctcccatccttcccccaactccccagagtccattatgtcattcttatgcatttgtgtcctcatatcttagctcccacttataagtgagaacgtacaatgtttggttttctattactgagttacttcacttggaataatggtcttcaactccatccagggtgctgtgaatgccattatttcattcctttttatggctgagtaggtatttcattttatatatatatatatatttatacaccacattttctttatccactcattggttgataggtatgtaggctagttccatatttttgcagttgtgaattgtgtcataagctaaatgtttggaaatacattggaattatttctgaagttccggaatggctttgctattctacattaggtggtttattgaatatttttagagaagaacctcttgattttcagttgtttgtgtggggagaagagatggtggtggtggtcattcttcatatggggatttggaagatgaaagagtaggttactcattctttatatggattttcatcagtccttctcattttggccttgcatctcttccccgtaccctatcatacctgatctttctgggtactaagcctgtacaaggtttctaaacccttcatggcttccttcatggctgtggtccactctatgacagcccaggctgcagtttccaccactatgtatcaacagctccatgttaacaatagctttctgtctaccagaaaattgaactttcctgaccatttctgtttgaaatataggtaataaaaccacttttaatatgtggttatcatagggcagaatttttcaacctcggaattattgagcactattaacatctagggccagataattcttgcgtttgtctttcctgtgcatcgtaagatctttagcagcgtccattgtcaagtaacaccccctaccaattgtgacgatctcagttgagaaccactgtcataaaaccatgccaatgagtaatcatgcaggactgtgtatcacaaacagaataccaagaaatgtaaataccttctgcagaagcgcaagcatatgtaaaccaactcaatataatctggaaggtcattaaattacattatactatactttagaaatataatgtctttgtgatatcctgagacaagcagattatttaaaatgttctgactttcgcagtgacattgtgccttttttgtgttccaaaattttcttttgataagcatttctaaataacttgggatttatcctttttcatttatgaaggccttttatctgctaatagaaagaagaaaaaaagatatgctatgatcattttgcatactgcctcattgctagagatgctttccctcacaggatacataatttcttggaatagactattgttcctagaagataattagtgactgttttttttttttttttttggttttttgcctgtcaatagaagtgaaaacagtagttggcatgctcacctacttgattatagctattacatcaatcagcatccttttcctatgcttcatcatcatttatctcaataattatatattgtttcatttttctcaccattttttctttagcattaactatacacaaatttatttaaaatggctgaaattagtcatgcaatcagttggaattcatcctcacaacatttatgcaaaatctactgcagtaattgttttaaaagtgaaatttaaaaatattgaaccacctttatttattctacatctagtcgtactctcttttgtttaccctccatgtttttctccactcatttggtcagaatcagggtttagtgggtggttaaatgtgttctgggatctgccgtgagtcttggtgcatcaaacagggctgaagacaatgaaagctgtggcataaaggacaaatgtagaaggtgaaaaacgaatagagaccctgaaccttaacattatctccatgttgaccacggtttcctttggtattcttgagtaattctatgacgaaaataatgaatagagtattttcattgtttcttttaccttggaggtttatcaagatgttggacagcaacgaaatgtaaattccgtaactcatgtgttaggacactacttcataataaatattttttaatgagaaaaaactaaatcatgattatatccaatttgccagttaaatatgttccacacatcagtgaactaaggaagtgctggagaattgttcttagtaacttggataagcaggaccccgattgtattagtcaaaaaataaatttgggtgtatactttttattgatgtgtcatagttatacacattttggggtgtatgtgatattttgatgaatgtaggcaatgtgtaatgatcaaatcagggtaatggggatagccctcatctcaaatatttaccaattctttatgttggtgggaacattacaattcttctcttctagctattatgatatatgcaataaagtattcctaattataattttcctgctgtacaatagagtactagaatttattccttctatctaactatatttttgtacatgttaatcaacttctcttcaactgcccaaagcaattgacacattcattgcaatccctatcaaagtactaatgtcatttttcacagaagtagaaaaaaaatcctaaaattcatatggaacgaaatggagcccaaggagccaaagcaatcctaatcagaaagaacaaagttggaggcatcacactacttgagttcaaattgtactacacagcaacagtaaccaatacagaatggaactggcacaaaaacaaacacatacaccaatggaacgaaatagagttgttatgaccaaccattctattctctaccttcataagattgacttgttttgctctcacatatgagtgagaaaatgtgatatttttctttccgtgcctggcttatttcacgtaatataatgactttccatctatcttgctgcaaatgacagattttcatactattttattgctgaatagtattccaatgtgtacatatgccacattttctttttattattttgaggaaactccatagagttttccacaatggcagtactactttacgtttccaccaacagtgtacaggcattcacttttctctgcagcctctccaacatttgttattttttgtctttttgataataaatagcatttctagctgggctgaaatttctcttcgtggtttttgtttgtgtttttgtttttggtttgtttttgaaacggagttttgctcttgttgcccaggctagagtgcaatggcgcgatctcagctcactgcaacctccgccttccgggttcaagcgattctcctacctcagcctcccaagtagctggtattacagctatttgtggttttaatttgcatttctctgatgaagatttttgctgttgagttgtttgagctctttatatattctacttactaatcccgtgtgtattagttcattcttgaattcatataaggaactacctgagactaggtaatttatgaagaaaagaggtttaattgactcacagttctgcaggctgtgcaggaagcatggctagggaggcctcagggaattcacaatcaggcagaagtgaagaagaagcaggcacatcttcatatggcagagcaggagagagacagcgaagggggaagtgctacacacttttaaacaaccagatctcctgcgaactcactcactatcatgagaacagcaagagggaagtccgcccccatgatccagtcacctcccacaaggcccctcctccaacattgaggattacaattcgacatgagatttggatggggatgcagagccaaaccatatcaccttgtcaggtagatcatttgcagataatttcttccattttgtaggttgtctcttcactttgttaactgtttcctttgctgtgcaaaagctttgtagcctaatgtaatctcaattatctgtttttgcattggttgcctgtgcttttgaggtcttaaccaaaaaatctttgctcagagcaatgtcccctagcatatccccaatgtttttgtctagtagttttatactttcaagtcttatatttaagtctttaatccattttgagtttatttttgtatatggtaaaagatgggtatctacttttctgaatatgaatatccatgtttcccacaccatttattaaagagactatcctttccccaatgtatgttcctggtgcctttgtaaaaaatgagttggctgtaagtgcatgggtttgcttctgggctctctattctgttccattggtgtatgtgtttgtttttgtgccagtaccattctgtattggttactattgctttgtagtacaatttgaactcaagtagtgtgatgcctccaactttgttctttctgattaggattgctttggctccttgggctctatttcgttccatatgaattttaggatcttttttctacttctgtgaaaaatgacattagtactttgatagggattgcaatgaatctgtcaattgctttgggcagtatggtcattttaatgatattaattcttccaatgtatgatatgagtgtgggatgtcttttcatttgtgtacatcctcttcaactttcttcatcagtgttttatagttttccttgtagagatctttcatctccttggttaaacttattcataggtattctattttttgtgctattgtaaaggggatttctttctgagctagttaattatttgtgtatagaaatgctactaatttttgtatgttgattattatcctgcaacttcactgaattcatttatcaaatctaagagttttttggtggagtttttagatttttctatgtataagatcgtgtcatcagcaagtaaggataatttgacttctttctttcaaatttgaatgccatgtatttctttctattgcctaattgtttttacaaagacttgcagtactatgttgaatacaagtggtaaaagtggacatctttgtcttgttccagatctgagtggaaaggctttcagtgtttccctattcagtaagtgaaggatagtagagattagccagagcttatctcataataaatgactatgacattagcctaaaatatgaaactttccaagaccacttccctttgggggatcacaaggagatgagtcatcagtcactgccttacatttttgaaatataaatcaacattgaatagtaaaattagccttatggataaaaagaggtgactaaactgatttataaaaacttgtctctggataattaatccaccctaaacttgcttctcttatgttgtctccacatatggttaaatggtaccaccattcatgtgtttgctcaagctcataactagggatcatgccccttaactcatgaacattcgtttataattcacatctagtcagtcagtaaattttgttagttctacttaccaaatagatacttaagggaaaaaaattctaccacttccaccaccaacactgtgccgtcgcctttcagtggactgcctcaacatcttcctccctgccttcctgcctccattctgcctctctgcctccacaccacttcattctcccagacttgaacaccaaaatgccagagtgatacctctggtacaaatgctacttggggctctcttatttttaaaactctccaaagcattcctcttatacttaaaataaaacccaagtcctttccatgttctacaaggcccttcctgcattggccagtggctatctttgaattcattgtcactctttttttacatcattatagatacagtggcattctttgccctctcttaagcatgccaagtatactccatctcagcacctttgaacttgctcttccctctgcctggcataaacatcctccaggttttgctatgactcacttcctcccttctcacagatatgttccaaatgatcatcagagcaagctttcctgacagttttttctaaaatagcatttacattagtctctatctctttagctgctttaattttcatagtacttataatcacctggcattatattgtgtgtgtatcaatttatatgattattttgcatctccttctctggaatgcaggcttcatgaaagcagaagttttgtctgtcttgttcactattatagcccctagtacctggtagagaggaaatattttaaaaatattttttgaatgaataaatgaatatttttatagtttaattacaaaccacacttatcaaattaaatgaacaaaatactaagtatcaaagctagccaaatgaattccttggctttcctaaatacatgtcttttgatggatatattatgagttacttccttggaagtatttgttctgtctccttggcatgactcttaagttaccttgtatatgttgttagtttagtcatcaactgacctccccgcacctttctgttcagttgcttagtcactcctcactctttgaggctcctgaggctccatgactccgtggttagtcaccacaattatttgcaacagaaaggagaaatgttgccaaccccaaagcattagagataagtgaaaaatagagcacccctttcaccccaagtggattcacctagtaaatgttgatgttttcttctgtccatttccttcttctgcaaggaccatgagattgtgtttacattctacagctctcacaagatgtatgctccaatattagaaactaatgtttaaacattccaggccaaagaaagcaaaactgaaattccactcttgagtcattcagaggttgaagcattatgggtgatccaagttcccctgactatctgtgaacacaggcagttgtttgtcaattcttttaagttaaaaaaaaatgcacaaacaacctattgtaaaatggagtgagtcagtgcaattgcacaaagcatgttttattgtcagctgtataaatctgtgaatatttttcgtgaccagttttagttggtggatttaaatgaggtcaccaaaaagttatctctgagtatagcactcgccacagtgcatcataaatatgctctcatctatgaacatccttatgaatgactctatgtcttactcattcttttatctctaaattagtactgactattttaggtccttcataaatgcttttgaaattggattatggaggtatttataattatctagattataagctctttcaggactaaatgctatgttttgtttacatttgatccccttatagtcctgtacattgccttgcatatttaaaagtctttagaatatttttgttgaattgatttgttaagtatagatcaatccccctgctatggaaactaatgtggaaagtgttaatgattcttaaatcagggtctaaaccccttttgatcctttggttggatgtccagttcattatttcacaaatagtaatatttttcttgtcaggctatataggctgctaaatgctattatcccaaactttgatggatataattagaacagatttattttccgtctactatatgcaggaacttaatctgttttcctattaaatcctcacgacaattcatgcaggaagactatgtcacattctccatataaaaagactgagactaagagatgttaagtaatttatccaacttgccaaacaaataaggcagaatcaggaactgttagacctgtttccttgaacactaactgtgtgaaatctttcctactctaccacaatgcttctaagaaacaaagtgggccgggcgcggtggctcacgcctgtaatcccagcactttgggaggccgaggcaggcggatcacgaggtcaggagatcgagaccagcctgactaacgcggtgaaaccccgtctctactaaaaatacaaaaaattagccaggcatggtggcgggtacctgtattcccagctactcgggaggctgaggtaggagaatggcatgaacccaggaggcagagcttgcagtgagcggagatcgcgccactgcactccggcctgggcaacagagcgagactccgtctcaaaaaaaaaaaaaaaaaaaagtgaagggaactagttaaaatacattatgaaaattatatatgactttgaaagaaacattttatggtaggataagtatagatatccaaaatgtatcgaatattctcaatagtatttgagggattagtatgtgaaggattaaaattaacttttaaaggcgtgattgttcaacagagaaagatacatgtattatagacacctcacatttctctccacgttaagaactttaaaaagactcaagaatcttggcctctttaccctggtgttgtcatatttgttttaggaagatagtgttttactttttaccgttccatagctcaagtgtaaaagggatggggaaaagagggagaggctgtatccctttatgaatactcaggaaaagttaatatagatagggaatcaatcctgtacacatcttcatgtgttctgacttctagatgtttctctaactggtagctagtaagaaaaattagtgtccttaaaatgttccttctattatgcagaagctttgtcaactgagacattaataactctgtaagagaggtctgttattatttaaatgtctatagagctttaccgttgttaataggatgttctgaagaataaaatgaggtcttgaaaatacttttgttggtgaatacaaagctatgtttaatgcaaaattagtgagagaaaaatctctactataattgctgtgggtttttgtggacaaaatatgattaggatttaaaattaccctgtgcttcatatcattactgttacactttgtttagttttcaaagtgatttccatttgtgagtgagtgtgcatatgtgtgtataggtgttttcaaggaagagagaaatgtcttcgtaacacaagttgttttcttaactataaaaagccagttggcttagtcatggtctaatgctaagaacgtttcttttaaaattgtaatttgtttgaatttccttctagtttcacctttgccagtgcagaaaataaagagggtttttgtggttgtgtgtatgttcatcttgattggccattaccatagctgcatttgttttccagttctgtgttctgtcaatttaatccaactaatatttatgaaataccataatgttccagaaacattcaaataatggaaaattcagctcatattcttcctttgtgactttgtgacagcaaaattggtcaccctcaagtgactgtagaactgagctacatcttagctttagcagtcacctccttttcacagtcattttgccaatgtgtcaaatcagtggctcagccattgtggtctctggaagtttcccttcacttctatcaaagacaggcaaatcacatgagaaatgtatccaactgatacccatgataataccaaaacatgacacttacagatgatgacagattgcatggcaagagctctctgccgtaggttatgattatttagttgcatgtttccagtcttgtaacagattgcacacaccttgaggggagactgcacagacccatgcaatatttgcttgacagaattttccaaggagcacataacaaagaatggggaggaaaagatctaggaaggattctagtttgaatttgctctgttatttttggcaagccttttgatctttttgtacctcagatccttgatctctaaaataatagagttgaatcagtccagtttttttttaagttattaatattttttattaaattaaaatttatttttaaatttttattaaagttttttaactacaaagcaccgtaaggtataaggacagaaactaaagatattccaaaccctgtatcataatatctggcacattattctgtttaatatatatcagttgaattgaattggatttgtttggtcaacatcttgggtgaaatactgatgtataaggtaaaataaaagcagaactaattttgtcaaagaggaatgggtggcacaacaaggcagggaactgagcccagtgggcacccccaaactccacctactcagaggggcatggtgaaaatcataccatgttagagaacacagtttccaaatcaaagaacttaataaccgtgtaattcttcctggcttcaacattctataattccatgactgagctttaaagaattcctttactaacatctagtttgccacatgaaagtaatatgaaagatgttaaggatgttgtaacattatgccgtcaagtgggtggtgggttatgatggagaaccacaaaaccgttttgtatttctgaacaaatgtactgcatacgggttttattatctttctctgtagatctttattttttgccttactgcaaactaatgtggtatgcgtttgaacagggaacagttctctcaggtgctttctgtaaaaaactgtcaagtcgtctacttgtaactacatagtcacaagattatataaactgacataatttactgaatacaacacttatttagataccatagttgcttttgaaattcactgaaaccatttgataaccagagtctaagaaatgtagatttccaacctattaatggcaaactattttgccaatatttagtgaatataagctgattatttaggcagtagaaaaataaaatccattaagatcactttaggcaggaaataagagtattaaagattaatcagagtgatatcatatctttgagaagaatttcaaagcgattgatctcatcctattacccaaactttcctttgccctttatttctgtcctcttgttaaatagtaataaagatgaatggataattattccatgagctatgaacaaaagctatcaatcatatatgaggttgttcttccaaactaaaactcaaaactcattccttttattctctgacttggggcatgtcattcctttgtacttaatgtgttttcctttaaaaagaagaggaggcaagctgctaaagcttgaattcttgaaccctctggtgataagtatatgtggccaactcttggcaattctgcctagattagccttccagttatcaaccaagctggcatgtcctcttggcaaggaagaaagaaagccctcaaagcaaaaacatttagtttagcaatccttaaatgataatttatatacttgatacagagtagaaatttcggtgacaggtttcaagggacctaggcaattcgatgagagagggcagggcagagtgaggaggctagatgaaggagagctgactaactaaagtccagatatagtctagtttagctaggaatgaagtatgcaatggaaaacctatcttcaagatttctaatggcaaactcttagatttgtgggctgataattgaagttgacgagagcacagagcagaaatgtgtagaagcttaaaatcgaagagagtatatcatgcaaattagcaataaacactataaaatgtaacggataatagaaagagtttagactaaatggaaaatatcatttaaaatattcccttggtgtgggtgtgcatgcttgtactaatttaatgccatatctacctcacttagattatgtatgtaggaaatacttaatgtaataactaaatggcagattttgaaatgatgtgatctaggatatggaaactaggaatggaattaagaataatgagataaatttatgccaaaaaaaatcattgtaatacatgccacatatatcatgtgtagctttaattaacacagaaaaaaatgcaggacatcccattaaaagtaaaacaaagaacaaattgaaaatgctttctgaaacacagttatatgttcacaaggactgaccaatcctgatggtctaattcattagtgtcatgtgactgtcagtctggaagtgttatattttactcacgtacaatctaatagcttttcagcttgcctgaaggtgttatctgcagtatgttcatcgttacttggtagagcactttaacactactttgaaagtgaaaaatatttgggaaaatagactgtattctatcttttagttttatgcagcataactataagtctctgtattattattgttgttgtttttcagcccctctgactgataagccacccaagcttttgtatcctatggaaagtaaactgacaattcaggagacccagctgggtgagtaattccttaattctagttaatatgctgctctcgttacattgtgacagttaataagcctagattgtaacccgatgtaatactcgcagctaaatccatttgtattcatagggaacagaattagaaaatgctagcatacctagccatttcattccttacagtgcgtgccttaggacccagttggacatatggatgtaaaaactcacatgctatttagatggttattggaaaatgagataggctgatgattttagtgatggtattacagcactgtcttacaaggtttgaattggttttcaaacagacactatggaacaatttgatttataatatctattaataggttaagatgcaatttctgaaatttaggggaaagggttcaaatttattaaaataaatgtcaccattatggttaaaaaacattttaagtgtaatcaaatataatataaattttgctagttatattttggataatctattaataaaatatgaccaagtgacttttggttaagggactagcagatttgggacataaggctatagacaaaatatgtattgaaaaaatgtacaattatatacgaatcagaattctgacttatcttagaggttcatctagaaattttgagtttgatttagctatattcagttatactaaattatgaaaaatttccctcttaattataaatatatacatagcaattctgttatattctcttaggtcttattttatttgaaatgtagtatgcaggcatatgccataaactttggcagaagagtttttgtttgtagtggtgcattataaaaggttatcaaaaatatgaatttaaatgaatatccatgtttgttaaggaatttcttcttagattaatcatacaagagtgaaaatgcatgtactgtatataactaaaaagaatcagtataccatcccttaagttattaatgttattcttattcctggagtgagaatttgcatcaaaattgtaaattcattttccaaatgaagattacagatgtgataatctttactaataacatacccaaagttatagtacacaaagatatgatgatggttttagcacctataaaattattgtggtcaatggctttctagcacttgaaatgcttatatttgctaagtttaaagcatgaacatacaggatttatacaagtcagggtgttaatatctttctttgattcaagccttttgaattaatgtcatataaatgcaagtagtattataattgctgttattttgagatggaaggttacagatagcattgaaacagtgccacatatgaagcaaataggtgtactcaaattttatcatgcactttatgcatgccatggcatccttaattacactagaacttattgctacattatgaatacatttttatttataaattcccataagtagccatgctcatactgatctttcaataattcataggaagatgtatttctaaggagttatataaaactattaaacattttgggccgagaatggagggttttatggtaccagttactataatgaacatagtaaaaatgaaattaattgtacgcctttgcttgacaatataatgaaaagaattttatggttgattgttgcccattgggtttctttttactgtccttgaatttgtaataagtcagattgttctctacctcttactacactgttttacaaaatagaataattggtaaagctgtatttaaagctttaccttctcttgaacaaagtcacaaagactaaccacagcaaattaaaaatatggaaatttcttaagcaaattggaagtgactatacattcatttgaagaaatatgggcatgtctgttactaaaatgcttcaaaaaatactcttaaatcctttattgtcactcaaaaaggagcatgaggtctctttaaccactgactaaactagtggattattttaagcaacttttattttgttgtgttttatgattttggttcatagtgtacagataagtcgtttactagttagagaaattcaaccttaatctttggatttgtgagcaacagttgatttgaagtaactaccttaatagtattcttgctactttgctagcattgctagtaagtaggtgaatcaaaaagggtaagtgaaaataggaaagaatattaaagacaaaaaaggcttgagatgaggtgtctaaaatatacgttttttccaaaatatgtatttggacttttcattttcttaaggatttaatttttgccctttccatatttgacaaaactgcctattcaacaggttcaaaatatgatataaatcctaagagggactgagtgaagagtcacgggttgggagtaaagagggtggcctgcgcccatgatggggaacttataacctactctgttgaaaaccttcaacagaattttacggtccaagtattcagaggtttgcctccacttgttcccaaattgagagttgacctcagagggataaccaaactcttgtaagagttacgttataagaaaaatcatcaggaattacacaaagctaagcttgtacatgtctggtgacctaacttgagcatcctagttaagttacacacgtatccaatcaaccctagtaactgtgtgtccatagattctctagtttgctcacaaatatatgtaattcattaataatgaactttgatataatcaggaagtgcatggatttgctcttcatcttcaaattcattttctctgccatttgctagccgtgcctacctttcccattttctatatttctgtattttcttgtgtcctgttcttctaattcctccatcttttcaaactggaaagggtttgatagtggtcatttaaattcttttattgtagaaagaaagcaaaaagcactaaaagcaaagtacttaggaaaaaatcatataatggaaactaaattcatataaaatatgtaaattgtcggctttgaatttgaatcaatacgtggtcacaacctggcatttccattttaagtggcaactgtatgttatttctaaatgtaaaaaaaagaacactgtccatttacataactttcaggcatcagcaaatatgtgaatagcacttttttgggcaaaaggcccagaaatttcactgtacagttctggaagtcaatctgggaggtgagcctgagtattttttcaggctactatagtcaagagaatcaaaagacagccacaattgtcttgctaaacctgagccctgaggatgtcattcagagatgtggcctgcctgttacggccaggagcccactttcagaaccgtccaggacagagagcatattctatcgctaccagactttcaaagagtagaaatccaccctacccttgacctaatggtacaaattatattttacaactcagaattcactgaaaattatcattaattacttacctagatatgtgtatcactttatttaaatgtcagtgttgtctttaaaataattataaaggttaatggtagaaattttggggaaatagagagaagaatctttttcttacactctacattataaacgcattctgctcctattaaatattctcacaaaatatccttttaatggccgatgtgaatgtcatataatttcatatatattgctggaaatttgaattcttcacatttttgttattataaataatgtgatggtctttacctatacactttccctctgactctatagttatctcaacagaacaaattcctaaaagtaaaaatactgggtaaaaagaaataattttgttaaaggttcttagtacatattttcagaattcttaccagagaagttgtataaactcccaccagaagtatgtaataagtataaatactacttaatctttaacaaaattaataaaagtatatctttataacataaaactcttaaagatctctttgatactaaaatcacctctctctcctctcttttacctctttttctctcttcactcattaagtacaagtggatgctctttgagtttatccgtatttgaaagatctagcccatttaggtaaatgtctacccttgagaaaatatacaaacctaatcgaatgtctataatctctatccattttcttctcttgctcatcctaatgctcagctaggaccttcctccagattctatgtttcttaataaagtgcccagtaatttcgtgatgtactgtgggcacatggaatgtcaataaatactaactgacaataagttcttcacagcacaaaggacacacacctctaaattttctgcaagagaatataatgtgtagactgaactgtgtaagctgcccaaccgtgctcttatttttctttactaatttattctcattgttaagcttgttaaaaagcaagcactttttgtatctgagtgggtaataaggattcaccagatattcacatctggaggaaaatggttggggacataaagaaacttcagatttttaaacatagatcttagtaaaaggatacacattttatccaatatatgcaattttatccagtttaactataggctacttaaaataaaatgtcacactagaaattaattagcactccttggcttgttccaccatactgtagttgcagaattttagatttggaatagaccaaaggaaaatgtccatacattttattacagatcataattgaccacaccttttctgaatagttactactctgtgttagtaaacttgggaaatctttttgtttcctctctagggtgagaaaatacttaatataaatatcctagaaacaacattatttaggtgttgaatttgataccgaattctgaaagtgtcatgtaatactgttgagtctaaacattattgttttgctgagttgtacaagtgatgtaaatatgacagttcccagagataggaaagtcagtatcggccagattttctcatctacattcacgctactggttgtcataagcaaatgtaaggccattgatttgattttaccggatcatagagcatataaaggacatattttcaccaacaaactcaaattaaaaaaccgtaaaacttccctttctactacgagaaaaacaataatatcccaagtccaagctttttatggaaaatgtggttctttttgcccatttaagaaagacataccaatcagcatatttctagtgcctgaaataaacctgttagacataaattaaaccttttggacaaatagacatcgtaattaaaccatggaaagataaataaagactggtattataattatttaaactatggcattcaattctactcaatccaaatttatcatcccaaggtaaatgaaagtggtaactcttaacagctctcttagtctgtcttgcttttgaaaccaaaaagcaccctaaaaattgtgactgacctaaaaaggaatacttgtcataccactatttcagttattatcgtatatcattaaacagatgataaatcaataaatggaaactagtattcgtattttgaggtcattgtatgacctaacttacatgattctctcagattctcaaattcagtcactttttggtgacagagaggagaaataggtttggaaaaaaatacaactgcatgtttgctttaaaaactgctatctacgtagaagttgaaattcctttttatgttttaagtggtcagggccagtcacggtagctcactcctggtatcccagcactttgggaggctgaggcaggcaaatcccttgagctcaggaatttgagatcagcctggtcaatatagtgagacctcatctctacaaatatacaaaaattagcttggtgtgttggcatgcgcctgtagtcccagctacttgggaggctgaggtaggaggatcacttgggccgaggtgattgaagctgcagtgagccatgattgtgccactgcgctccagcctcggtgacagagcgagaccttgtctccaaaaataaaaaaaagttttaagtggtcaagccctagttctaggacaggtttgcaatcccataaaaaagatggacgtgaaggtaagaacagttccagtgggccaatgatatccaaaagtttggaagtcagttaaagcacttttttaaaaaaacttttattttaggttcaggggcacatttgtaggtttgttatataagtaaacttgtgtcacaggagtttgttgtatagattattttgtgacccagctgctagtacccaatagttatttttttcttctctctctctctcctcccaccttccaccctcaggtaggccccagtgtgtgttgttcctctctttgtgtccatgtgttctcatcatttagttcccacttataagtgagaacatgcagtatttggttttctgttcctgcattagtttgctaaagataatggactccagctccatccatgttcctgcaaaggacatgatctcattctttttatggccgcatggcattctgtagtgtatatgtaccactttttaaaaaaatcgaatctgctattgatggacatttagactgattctatgtctttgttcttgtgaacagtgctgcaatgaacatatgcattcatgtgtctttatgatagaaggatttatattcctttgggtatatatccagtaatgggattgctgggtcaaatggtagttctgtttttagctctttgtaaacagacaacctacagaatgggagaaagtatttgcaaactatgtatctgacaaaaaaggtctcatatccagcatctataacgaatttaaacaaatttacaatgaagcacttgttaaagtctttaaaaactgggacagagacaagtgagttttcttgttcacttactttccaaaagggccagaagggaaagaagaagaaagaaaaggcccaagaaagagtgctgtcacagagcaatgcagagagtccatttaagcttccaactcctggtctagtccccacgctggacactgacacatattatgcagattactcttttgctgcagcactaagagtactattttatttgttatcagtcagttaagaagctatataggtataaatctttgcaattctaaatgaagaactttaggaggtggagggggtctggaagttatcaggtcaaacctttttctttcttttttttcctttttttgagacagagtcttgctctgtctgcccaggctggagtgcagtggcgccatctcggctcactgcagcctccgcctcctgggttcaagggattctcctgcctcagcctcccgagtagctgggattacaggcatccgccaccatgcccagctaaagtttgtatttttagtagagacggggtttcaccatgttggccaggctggtcttgaactcctgatctcgtgatctacccaccttggcctcccaaagtgctgggattacaggcgtgagccaccacacccggttaaacctttttcatttattgatgagaaaatggagactcaaaatggctacatgttttttacataaaaaatttacaaaagcttgttattgccattatcatcatcctcatgatcatcatattatcactgttagtgtttttgttgttataattaagaggcagtgtacagtagtggctcccagttgaaatctcacacaggcctatgtgacagtttagctccaccatttacttctagtgtgaccttgaacaaccagctttcagtttcctaatcaataaaaaaggtaccaagatagtactgcttctatggaggtaatgtgagtatttgatcggataatgcatgtaaaaattaatagattacttggcatatattaagtagtcaatacatgtttgctgttagtatttgagacatttgaatgctgtaaaagagtactgtatatagaagattcttgaaatgcattttgaatgtcaatgcttatttgatcatgcttatattcttactacagtatcatactatggcagcagatacagccttcattacaggataaataagattttagaaaatttatttccatctcccctttaaggattcaatatgcatactaaatttttgtatttcaatgaaactttttaattatagaaattattgattttagattacttaattcatcaagtctagccaaatgcatatagtaagtacatagttataacagaagaaaactatctctattcttatttaaagaaaatgataatttaaaggacactatgccacatgaatttataaatgaccatcaagacaaaaataagagtaaaaaaatttctcttttgtaaacagaggaaattcaggtataatatttttaaaaacaagagacctggaaaataattttccaccattatgcctgtcaagttcttcatgaaggttttgatgatagtcatatcattttatacaaaaaaatgctgcttttcccctgacaaacactgttatcacaaagctttctaagtcattcttaatgattgaagtttactagcatataaaaatacagtcagtattgtatgttaacaagaactactcctgaatttgcaaagtaaatgccaatttatcagaaataaacctatcaaagaacattacgttgtagaatattgaaagaggttttagaataagagtatgcactgcatgactgatgtccattaaaatagaaactataaaaagacccacatcatttaaagtttgaatataaagagatacattcacccataaatttcctctcaaatttcagctaaataactaaggatttctaaattatatgcagactctccatgaaaaataactagtgcttcaataagattatgaaaataggttaccagtattttatgctttcatgttaaaacacttagcattcctgtcaaaccttactttatcaacttagtatattcccacagatttgtgggtaaattgaatcatcatcatttcagagaagtgttcccttcatttttgattgattttcgattagcagtggcttaacatgtcaggtttaagaggctctgtcccccattctcttttaagcagctaatgatcaatgaaagatttatatgcataaaggaaatatgctatttaaagaaactctgtggtgaataattttatataagaacccttttgtaactgaatgatcacccccataagttttccctgtggtaatgcagatttttacatttttgtaagatgaggttcatcgatatgaaactgcaagttgcatctccaactgatccagaaaaaggatcatccacccattaccatgtgtgacctcccgttgtttattaatggaaacaaatgtcctcattgtgactttctgcctcctctgaggaaatattacattttactcaccagcttcagaatcaacagtatttggttttaatctaattctttgaaaatatattttgtagggtagaatagttaagtaaccagaatatctcatgtccaattatgacaaaatagtttattttcataagggatatgctttgaacgccatcctactaccttatctgccttggttttgttgaaatataccctagtaggataactgcccatggtgtcacttgtttttctataactgtgatgagagttcttatttccaggtttaaaaggaacatcttgtattttgattcttctaaaatttgtatgactctcattttatcattctggcagtcacttctttttatcttaatgtattcatatatgtttaataatttcttttaaatataaaagtatgtacaatgccacttgatttgcagctttatgaatgaggctattaccaaaatgtacttaaacatgtgctccgaaacatgccagatatttacatgagtccaatacatagagtgtccataaggctttaaaacctaagccccatagcaaaacttcatgaagaggcttccttccaattcaccacacacaagttcaacactactttttttttttttttttttttttttttttttgagaaggagtctcgctgtgtcgcccaggctggatgcagtggcgcgatctcggctcaccacaagctccgcctcccgggttcacgccattctcctgcctcagcttcccgagtagctgggactagaggcacccgccaccacgcctggctaattttgtgtgtgtgtgtgtgtgtgtttttagtagacacggggtcccaccatgttagccaggatggtctcgatctcctgacctcgtgatctgcccgcctctgcctcccaaagtcctgggattacaggcgtgagccaccgcgcccggccaacactatttttttagaaatgccaaggatctttatttaattttgtaataaaaatttataaaatctcattataacatatactaattgaattatgaaaggaaaacaatcttgatttaaaaatttttgttttccaaaattaatctgttttaaaataagtcttggcttcatggtcttgtgagaagatacctcccaccgctagatctggtctacaacaagcatgacaaaaagccaggaagttgcttaagagtccaagagagtgaataattttctctcccttccacttctccccagtgaggctaccgactttctcactctctgagtgtttgtttctagtttagtaaaagcagagtacccaccttggacttgcctgttgaagaacttttatagaatggcggctctttgagtaggaaaaaagcaaagcagaatgcattgcttttctggaaaaataaaactgagtgcatcctgtcacatcaagccatcactaggaacaggatacttaacaatacggcaggtcctaggaaaatttgagattattaccacgaatattcagtaagaagccattaccattatgtgaaatagcttagggaaagttcagaaaacaaaatattttttattttctcttcttaaaagaaaaaaatgtaatgtttccgatgaacctgtatttctgatgatgatcatgtcaattatcttggcaactttaagacttcttaattaaatgattaaaagttgttactactttctgtaaatgtacctgtttttgactgaaatatttggggtgcaattagactagttttatgcactctgcttattgtatagcctatttataagtagtatgaatatttctttcagaattacatatcacatacaatattgattaaaagacttaaacaagatattgttcttaggcataaatataatttgttttttaaatcaggttcaccatattcaacatgaatgtaatttgtaatgattattattttaaaaaaaaccctgtctctatttaccataaataatatgttgtcactccaatgctctttattaggacttgctactaattacagagtgagaataaggtttttatgtaatgggagctaaataaaatgagtgaatcttatattagatgaatacatgagatttcagcctcaggagaaattgtgtgtcacagagaacatcggtgactattatgaaagacatgttcagtcaagagggaatcgtactgttgactatcaacagggcagaaagtactggattgtattttctttcagtcactatgtgcatgacctaaaatagagaactgaggcaatatatacataatttagaagggaaataatccagaaattttatttttgtctcaaatagatggctctttcaagcaaaggttaatttggggatttttttttgaggggtcaacttcctatgtctaagcaatttaaacttgaagaatcacaggatttaatacttcatagttagagctctggtcataagtgacaaatcacttaaaagacaggagtggtgctggccttaagaaggattggaataatgctcgactgttctctgtctttcttctctactctttctgcatgtcatcattttgtataggggtggagagtggtgggtctgggtgagtagaggagggcatacagggtgaaggaatacgttgctcagttcttctaaccaggaggaaatgtgggtttggaactttagtgagaacttgaagttccctaaggagaaatcctaattggcctagaatgagatacagatctaaattttggacggatcactatggcattagaggtgaggggcattggctcagtggctgttgtgtgtctctctctcctgtgatgaagcctgtatttttgtgtgagtacgtagatgtggcagttggtgggtgggtggggaggctggtaatggggcttttaacagacaaagataggggaaaaagcaatggttattatggagtccatcttttcatattccatattcaatatttgtttaacatccctggttaatccatctcattaatttagctgtcatctttattatgcctcttcattaacttagtgagggtagaatgacccatcctgattgatgcatttgaatgcagtctctcttgggctgaaaactcttccattgctcttctcccaactaatactgacatcctttcctgtgtatctgtagtgcatacgtctcaactctagacctgcattcatctctctgctgtctctaagcctgcagagtatgttctcttccagccttaaacctaaaccaaatggcagattcttagctgttaaatacatttttaggaaaaaattaatatgctttctagagctagagaatggattataaaatcaacttcacgtaatatgaataagtaaagtgaggccagatgtaatgctataaaggagaatggagaccatgctgaagtggggaaaacattttctacctataaaattttaaatttattgttaataccatcttggccaaataaaacttgtctagtgggtagttttagtccagtggcctgagtgtctgatgtcttgattggtaaatcgagagtttatactacgaaatactgctgcactgtggagccggtaggctctggattcagaatggctatcacgaaatatgaatctgttccatcatattatagattggaacatgacataatatgatttgtaatgtgtttggagtaactaataaaatctcttacccaagaagcaaggagtttagagcagcatagttaattatgaaaggagaatctccccatcaggcgatacaaaaatcatagagttagaatgaaatgggcaaattctctttagcaatctggccccacaaaaaagtagctatgtctattttgtcattacagacttgttaagttaacaaaagtagaaatgtctgttaactctcccagcagacattttcatttactcttctctgcacatttccactggatatatgtttgttcctaaggtcctttactcaaggctaggcattacctaatttacttgtgaaaatgtgccaagaaaaggatcagtgattattcttgcttcattatttaaagcctactttcatgaatgtaatgcagtcatcattcctatgtattgtcatcagagtcgagagttgggacgacagagagtagaaatcctataacaggcattagaatttttagtagataataccaaaaattgaagcagagtcagtatgtcagactctaagtttggcttggtaaaaaatcctctttgtaaattaaaaaaaaaaattaccagactgccagcttaaaaatattatgtgtttccaaatagatgagaaatgtttgaggtgataaatattccaattactctgatttgatcattacacattatatgcatatatcaaaatatcacacatacccctattagtatgtacaattattgcgtattaataaaaaggaaaaacatttgatgcaaatataattcttgtgtatgtgtggtcttaattgatattcttttaaccaagcttactgagatatttatattgagtaaactatatcgtgttcagggtaaaaatgtatatgttatgtgtctgcctgttatctagaagataaaggccactttcttcacagtctgaccccattttgtctttatagtctcatgcactctcctcttaagcccacgccactgaccaggcacccttgaccataccatggacctacataactctatcatttgtacatgctatgcccaccacctgaaatttcctctcctgcctttttcccttgtgcctatctactcaaattttaagaccaacctcaatgtcaccccaatgaactcttccctgactctactcccactaggcagaattaaataccacctctcaattgctagcaaatctctttttcacacctttattagaacatttctctcatcatttttgtacatatttttgtgtgtctatttctcttgttgcatttcggactcttagagcatgtactataatgttttcatctttacatccctgatatgtaggacagtatctgatgcacagaaataaataattcatttagcattcactcagctttaatagtcataaataaaaaccaacatacatatgtcactcttcttttagtagcatatactgcagagtaatggagtaaaccacgctaaaactgttggttttgatttaattgcctggtgtgattgaagattccccttcatggatgagagagacagatagagaaaggcctaggagtctggctagggaagtctagcaataagtcaaatcccgattagacagaggaggaaagatcagatggatattgaaggtcacaacagagcagtaggttgagtttggataaataaataggggttgaaagaacagttatatatcagttcagctagaagactggtcaagggtagagacttttcactggcgtcttgagtttcaggcagatctctaaatttagtaaagtagactccacaatcttagggccctgaatgagaaattggttcgctagttccatttatgactttattactgggcacaaggtctggtcaaatccacataggtggctaggtaggtagataggtagatgaatagatagatagatagcttaacaaacagacgactgtctacaaggagtttatgttataatctcggttaacctctggatgttccttgttccccaagacgccaagacttcctgtctttcctcacagtttcagtcatgaatgtcagctctcgttctaatgagctttttaatcacacagtcgtgatccagtaggtacagctttccttgattagtgatcttaatttatctttgctttgagagtaccttacatctgcaagacatttaagtatgttgtctcatttcatcttttcaacagcctgtgatgtctattttgcctccattttacagataatgatcaaagcttatgtgtggcacttgttgtgacacttctatacattagtgtattgaatgtgattacctgttttgctcctttgttgagttctaattgtgcacaacatgcaatactcccttaaatccataaccttcctgtaatatttaaaatggtctattcttacagactacttgagttctgttttcttccactgttaagagagtctatgtctcatcaagtagaacatctagtaataattccattgaatataaacttgtctttgaaatgtttctgtattatccagttcaggttgctaaaacaaaatgcctttatactattgcttccaaatcttaactattggaaacagtgccgcaacaaacataggagtgtagatatctattacagcataactgggttattattgttaataaaaacattttaaaataacttaaagagtgtaattggattgtttgtaactcaaaggataaatgcttgaggggatggataccctattctccatgatgtgcatatttcacagtgcatgctgtatcaaaacatctcatgtatcctataaatacatacacctactatgtacccacaaaaattttaaaaaactgaaaaatgccttatcctgattgatttataaaccacagaaattaatttctcacagttctggaggatggaagttccaagatcaaggcgccagcagatttggtgcctggccagggttctctgcttcatggatgatgccttctagctgagtcttcccatagtggaggaagcaaagcagctctctaacccctcttttataagggcattaatcccattcacaaaagcagagccctcatcacctccgaaaggcttctaataccttcgtcacctgctgataccatcagcttggtgattaggtttcaatatgtgaattgggtggggggatgaaaatattcagattacagcggtttctcaggtttttggttttgggttttgttttttgtttttctattcagttgcatgtctcttgaatctgcttctgttcatctttgcctcctattttctcattcccattttttttgtacttctgctctttcaagtacattttaagagacacttttcttctttcactgatcttcgagcatgaagttcttttcaaggcacttaggaaaatggaagtacttaggacattcatgaacagaatgtctcgagagctgcaaaagttaacgtgagaaaagctgatagaaaagttgcctagttcatcagagttttactctttaaaaagcagcaagttataatcccttcttaaatagcaagcaaaagcaagtggtctcatttcacttcttgaaatagacaaagtgaaactaataattgacttgtcaatttactacgactattaattccctgcacgcaaagttggacttcgttaatttaggattcacgttttctttctgaatataattatctgactatatacagaaaggtagtttgaagccagctagttattgtttgagcatttaaagttaaaaactatgtagacattagtaaatatccatttagaaaacctgtaacaactggatcaaaattaatcttaactgagaagttaaatttgacttacgatatttttatgacatttacagtgcatcttgctcatggcttgtaaatatatgttaactttaaagaacttgccaggagtggtggctcacgcctgtaatgccagcactttgggaggccgaggtgggcagatcacctgaggtcaggagtttgagagcagcctggccaacatggtgaaaccccatcttgactaaaaatacaaaaattaggcacgcatggtggtgggcacctgtaatcccagctactcgggaggctgagacaggacaatcacttgataccgggatgcagaggctgcagtgagccgagatcgtgccactccactccagcctgggtgacagagcaagcctccatatcaaaaaataaataaatcatgaacttggtaaggtttatgtagaaatagaggtgcttttattatgtaaatgtttgctgtattaacttaggaacataatttgcaatttttcctaaaggctgacatttaccaggtgtgaggtttcataaacactagtatcagaaaaacatttccagttgtgaaaatgattataagaacagaagtattggccaggtgcggtggctcacacctgtaatcccagcactttgggaggccgaggtgggtggatcatgaggtcaggagttcgagaccggcctggccaacatactgaaaccccgtctctactaaaaatacaaaaattagtcaggcatggtggtgggtgcctgtaatcccagctactcaggaggctgaggcaggagaatcacttgaacctgggaggcggaggttgcagtgagccaagatcatgccattgcaccccagcctgggcaatagagtgagactccgtctcaaaaaaaaaaaagaaagaaagaaaagaaaagaagtatagtcacaaggtgagcatgttattttaaacttcaatgacttaaaaaatataagtattgattttaattgcacgatagcataatattgaaaataagagagaaactgactttattctagtctgtgagaacaggttctcagtggggagataagactaagattctcatagtttattgaaataatgatcaattcaattatcaaatgcaggatagcattttgtattcagtttaataatccatcagcttttcaaataacatgttttaattgttttaatattatagattattttcactcttaaagtatcattttccaaataaagaagtatcatgatataagccattgggtagtggtcttgccactgactaattgagaatctcagtggtctgaggattttaatttccaactgtctatggcaatgattcttcactaggaatggacatgataaatacctgtagagcttttacaaaacatatgcacctagtttccttgatcccctgcctccccccacccccctaaagatttatttatttatttatttatttatttatttatttatttagagactgagtctcgctctgtcgcccaggctgcagtgcagtggtgcgatctcagctcactgcaagctccgcctcccgggttcacgccagtctcctgcctcagcctcccgagtagctgggactacaggcgcccgccaccacgcccagctaattttttgtatttttagtacagacggggtttcaccatgttagccaggatggtctcgattctcctgacctcgtgatccgtccacctcggcctcccaaagtgctgggatcacaggcatgagccaccgtgcccagcctaaagtttaatttattacatctggaagggaagctgagcaaggtctgcaaattttgaaaattcagagaaatacacatcaaatctacagtgagatatcacctcactctaattagaatggctactataaaaaaaaaaaacaaaagataacaaatgttggtgaggatatggagaataaacccttccatactgctggtggcaatgtaaattcatacggtcattaggaaaaacagtatggaagttcctccaaaaataaaaaatagaactatgatatgttccaagaatcctactactggatagctatccaaaagaaattgaatcagtaatttgaagagatatctgcacccccatgtttattgcagcgctatccacaatagcctggatatggaatcaacttaaatgttcatcagtggatgattgggtaatgaaaatatgttgtatatacacaatgaaatactattccatcatgaaaagaatgaaattctgtcatttgcagcaacataaatgaacattggggacattgtgttaagtgaaataagccaggcacagaacaacaaacaccgcatgatctcactcacacgtgaaatctaaaaggttgttctcatggaagtagggagtagaatagtgtttaccagaggatggagagggtaggaagatggggaggggtggcgagagattggtcaattgggtacaaagctatagttagattgaaggaataagttctggtggtctgttgcatagtagaatgactagcattaaaaagaatgtatatttcaaaatagctcgaagagaggtttttgagtgttctcataaaaaagaaatgatatttaaagtgatagatatgctaattaccctgatttgattattacacaatttacacatatatggaaacatcatgttgtgtcccataagtatgtctaatcatgtgtgaaccactataggaaaaaaaacctctgacctggtgggtttgatgttttcttagtcattatcatgatctctctatattctagagctctttgctctccatgtgagggagctaacagacctttctgggtgatctcatcagaaaggctgttagtgccaagaaaggaagactttataactcaggcacagagagtcccagtgaggctctgaagatcttttcaagtggaagcttgtatgacaggacactacactggggaatgagggtgggagtgaggtggagaaagaaggcacttctcagagcatagtaaaaatttagcaacaatttgagtcacttaccttactaaaaagttatctttatatctatgttagttttctgtggctggtgtaataaattacttgatggcttaaaacaacagaaatttattctcacagttctggtggccagaagtctgaaattaagggctgaaacccctcaggaggttctaggagagaatctttgcctcttccaaggtctatggctgtctacattatttgtcttgcggccgcaccagtccaacctctgcctgtgatcaacattgcctcctcatcttctctgtttttctttcccttccatctgtctcagctcttcctctgccttttctttaaggtcgcttgtcattgaatttagagcccacttggataattgaaattgatctctttatttcaagaagcttaacttaattatatctgccaagaccctttttccaaataaggtaaaaaattttacagtttctggagttgtaaaacatggttatatcttttgtgggggtgaggcgggcacgattgaacccactatagtatctgtcacatgctctgctacattcacaaaaactgatacttagtaaaagttcatgagattataaacagtgaagtatcaacaagacccctcattcaataattatcagggttgcttctctctctctctctctctctctctctgtgtgtgtctgtgtgtgtgtgtttgtgtgttctgtgttcatgtgtgttgtgctttgtggtcttttttttttttcacttgaagagtattcccatttagcccttgaagttaccaaatggggaagacattaccaaaaactatccattaacataagagttttgtggagcacaataagtaaagcaaagggaaacatccctctaaccctttcccagcaagaaaaaacaagataatcctggtagttccgagaaagcaaagaaagttagctctaactctttgtagtgaattttacagtattcagttgttctcgtacatttgtcaagagttgattcacctgcaatagaaaaggatgtctgtttacaagtggatcaatgattatatctactaatggaaaatggtagattgttcccaaagtcttcacaaataaaatctcggagataatatatctttctccgttagtagacacatcgtagtatctaaccataatgattacaggcataccttttttaaactatgggggcagtcacagtgctcagcattgcaggttttaaccttcatcagcagagtcagatattaaaaagcttatttcacgttgtatgcctgtatcaaaacatctcaggtagcctataaatataacacctactgtgtgttcacaaaaataaaaaataaaagttctcaatgtattaataagaaatcatgcatttatcaagcacttgttcaatgtttgtttgaaagtggtaggtaaataccaaaatgaatgcactgtatgagtttagggatgaagagcttatttcaaaagctcggtcaagcaaggcctaatggtgaaaatgttatgtgaactctaccttaattaaggtgtaggatttaagcagacattgatgaagtattaatagaaagacattgctgaaagaccagcattaggagaggcagagatgacagaacatatgttggcttttggagtgggcaactgttgtagccaactgaagaaattcagccaactgaactgatgaaaaatagtgctggaaaaaatagtgtagacacattacgaatttagatacactttcaatggaatatatcacaatggaatgtgtgtatgtatatacatatatattctgttgaaagtttcaatttcttatacaattaggaaagaaagagagcccaattaataaggtagtctcataatacattgtagaatgaataagaggaagtaggagccagaggtcagagagccaactgggaaactaattgtctaggcaaaaagtaatagagtaggatttgcaaaaggtcagagttgagggaaattgactttcagagaagtataaatcttattgttgtgtagactaatgctaagtaaagttgacagataggagtcaaagaaagtagattttaattatggttgagtgggaggaaggtgatatcaataataagaaaaagaatgttgtaaagaggagcaacatttgtgggaaatatgttgagtcaaactgtggttacacgacgatagtacattctgacaagtctctcccacaactggaaatatgtacagagctttagtgaggtattcgggctggacttgtatttgagagattctcttaaagaagtaacaaaggaagtcagatatttattgatgggaaggataacttactttctcatttgatctcagtattattggaataattaagcatactaattcctgaatttcttattttcctcttgaggacaggaaatgtgttttatttacctctgagtaatcagctgatagattgtcttcaaaaagttcctcttgaattactagagtttaggttgccgtgtttctgagattatcttactttttcaagtttaatggaatttaaaaaaaaatttactatatttactgttgtatcctgaaaacaaaagtatttctatgagttttactgtaatcctattatcatctcactgcttaatctttcaggtttccaaatacttttaaaatttactttaattgtttttaaatgtaatgagatgttattttaaaaactgttgattatttctacaaatgtgtcatgtccattaaaagtcactcattcataagtatatattatcaagttaatgtactagcgagacatcataaattatgcttcatctttctgctgttaattcacattattctccttctatccagggaaagaaggtactatatatacatgttattaaaatatttagaatctttgaataatttaaacaacattttaaataacagaatatggaagaaaatagaaaaaaagttaattgattcaatattttttttcaacaatttcttttaaatatatagacaaacccatacttggcatttatttggaactgtgtctgtttgcatttaaatttttgtgacctgcttaccaattttaggttttgtattgttttcttcttcctttatttatctttccatgctatattgattcctgagtgtttgagggacttccattttccagctcatttaagtgcatttcatcctgctgtgttggtcatcagcaagacacgaaaatggtactgaaatggccacataatgcaatgtgatttgaaacgaaggggaattgcacttgtctgttgggcaaggaatatttatcctgggttgctcgatgtatttagaaagtcaagagttatcaggtatttatttgtaagagtacagagaatcttgaatgctagtgattccaagacatttagatttcaggaaccagttgaattatttaaacaaacaaacaaaaaataagtaacgggaccataataaaggtgccaaatgatgttattaaatgataaagaattaagatctgctattaatgtaatatggaatttctaaaaggagcagtttaaaatccaaaacttggaaggtttctcagaggaagtgctgatcatttgaattcaatacattcaattttatatttgtcttaaaagctcactatagagccgagattgcgccactgcagtccgcagtccggcctgggcgacagagcgagactccgtctcaaaaaaaaaaaaaaaaaaaaaactcactatactgttttctgctgctaccaaattttgcatctaagagcatctgagacatagcatgattgttaatgatcgtgtcctgcctctaagaaacactacaatcataatacgttttgttttctctaccctaaaataaaatacttgagagtgaaaaccaatgcaaatgtgcaatatattttccccatatttgggaatggaatgtcctcactgatatgtgtgtgttttgtatttcatttacaatgaaggtgacacaaagaatttattctcattacagttgtatgtgtatacactgtagaatcatgttgtgaaagccatcttatataaaatataagtttcccctctctttttgcccacagccttaccccactacccagaggtaaacacctgcaactatagctgatgtttggtatttagttccatgcctcaaaatcacatgctgtactaagaacgcatttttctattttttaaaattgatttattgatttaatatgttgacttctcagtactgtagattaagatatagttctctatcaaattcttacccttcctacacaaatatgcatttcctgccttctcattctcccatgtagtaattttggctcccgtgctatctgccagttgtttgcaattatgaaaactctagcaaaagctgagccacttatagtaaatttccatctctttctctctttgatttgctttttgggacctttcctacactttgtcttcctgtcttcttactgaataatttttctaatacgtatttgtaattattaagagttttcatttttctgcatatctctttttctatagcagcctattcttgtcacatggagtcaagagcatctcttctcattctgaaaacattgaagttagttattttgtctgattttgttttgtggggttatttttctctctacataatctttatttttcccaagttcctattgtctgtttggttgcatgtttgagtctccctcatgttcaaggcttcctttgattttttgatggtccttggttgtctactcattaagtagaggtcactaaaaaaagtgcttggtaattcttagcagaatgttgattgtggatcttctggtttggttttctgctgagttgagaaatttctgctgttggtatctttaggtcttttgttttgcactggtcagattcacagagaatagtcctccaatatccagcctgtctttctgcatttgagagatgagcgggaaaaggtttcacatttggcataaaagtgcgtttcagctgcatgtttatgggtctggtgtcctgcagtgcagagactctctttcaacctctcaagagaataaacatattgtccctgtgatgacaaagaagggaaatcaatagctaccttattcataaacagacatttgacagaccctcttatttcctcccaattcttactctaccttccataggcagctggtgtcatcattcactgagcccttctggaggttctgcattggcaatcaagttgattcttagcttcaaccgctgttggattaggattcagctttttcaggcttctaagtgtgttactacttattcattaactttccagcttctaaaattctgctgccgtggtgtccttccttgttttctttgtcattatgggtttgtgcttaatttaaaatcccttcatttatatttccatgtgattttagaagggaaaaaaactctacttctgtgttgaattcactaccattacctgatagcctgcatgtgactttaggaaattggttcctgacattttatcagacaacagcataaaaactaaactgtcaacaagtcttcatagaggatttatgagcttgagcaataattgcaatactctctataagctaaactgacataactctaaatgaaagtgagcagtgtcatgtttgctattgttgatgtgctgtggacaacgtgaatgacagtcagttttaattagcccacggataattgcagtcatgtacctaagtcccattaatggtcactttttaacacctataacatggaagtagtgaaatgattcatttctttttttttttttgaatatggtagagaaggtcaactatgcttttgaggtaggaattattgataggatacttctagttggcttagcattttcatatctttttagcttaactatccattgtgagactaagcttattactgtcatgtaagattcggttaagtagcactattcatatctacaatctaccatgtggagtgatttgtcatcatttaaggaaaacccgtacatcagatataataagcagctattcttctggttaaccttttaatacatattattgggcagcaaaatcaaaacagaatctgttgtgtcatctctttggtacccaggcattttctacacaattgtaacaagactgctctggaaatagctataaatggatcctgctgagatctgctttttctcaattatcttatcctgtcaaacaagggatttttctcctcttcactttctcctccatttataaggatgtaatttcagcttgcaaattcgattttatcctttattgttagagcaagagatttcccagttttgatccagtctccacacttatggagggcccagtgtgaatgcagtatgcatatagatatcaatcagggatagcaggtcattccagccagaaaaactgatgtttttgcgtatatgtatatatgaatgataatatagggtgatggtgcctcagtctacttgtgctgctataataaaataccatagactgggtggcttatgaaccttgaaattttatttcccacagtcctggatgctaggaagtccaagatcaaggcactggtggattcagtgtctgttgagagcctgctttctggctcataaacagtgccttcttgctgtgttcttataaggtagaaggaatgagggatctctctcagggctttattttttataagggaattaattgcattcatcagagttctagccccgtgacctaatcaccttcccaaggctccacctcctaatgccattagctttgggttaagattttgacgtaataattttgggggaacaaacagtcagaccataacagatggatatggaaagagatctttagggacaccgtagttgggatggttatatctacttagaggggctggacaaggctccttcagggagacagtgttgactttgagattcaaaggatgaatataacttctccaggtggagaaatgtacaatgaccaaaaacaatatctgcaaaactcatgagcagggaaaaatcttaagtggttacaatgaagaaatgccttgaaatagaattaatgaaatttcacctttaggtctaactatgacagtatctaacatttactgaggactactcatgtgctaaacacaatgctaagataattatttcatttaaaacaccaactagattataaatcacattttacaaataaggagcttgaggtacagagaggtttcccaaggtcactaattattggagaaaatgagacttgaacccaagaagtatgatggtaagactcatagtattcagtgatatgctaacaacaactgacacaaatagttctttctgtcagctatagttgtactttggtctccagttatataatttgaagatacttgcagtcatagttcaggctgctatagcaaggtaccataggctaggtagcttaaacaacaaacatctatttctcatggttctgggggctagatgtctgagatcaagatgtcagcatgatctgtttcttggagagggccctcgtcctggttatgttctcatttagactttccttggtgcttgcaaggtggcgagagagagagagagagagagagagagagaaacagagagaatcttttatctgctcctctttttaaaaggagaataactctattatgaaagattcatccttacgtcataattacctgccaaaggccccaactccaaatgccaccacactgaggattagcgttacaacatatgaattctgctggtacacaaacattcactcctcagcaatggggtaccgagagcagcatcacatgtgggactgtggttgatgatggtgataaagatactgaaacttatgctattcttattgctaaatcatgaccacactttacattttaatggaaaacttcagaatagatggcaatgtatattttcataataaaaataaaatctcttctggtaaatttaagtacgtattggtcagttgagtagtttatgagatgtctttccctatagatcatagaattttagtgaggccttagaacagggtttctcatcctcggcactactgacattttgtgcttaatgattctttgttgggaggggttatatactataggatatttatcagcatccctggcctctacccactagatgccagtaccagtcccccagttgagccaaccaaatatttctccagacattgccaaatatcccctgtagggcaaaagtcatcccaaaacccaggttgggaaaccacagatttagagaagtctagtataatcccctcaactttacccaaaaagagaattgacgtgctgtaagcaaggtcatacagctaaactgtggcagaattttgattagatctcaggtctcctgagcccaaaatcatatttcacatataacaaactgtggtgtcttccacttaaagcagtgccttcagaacatatgatttaaaaagtacacatatatcatccataacagctcggcagacaggtagaataaatgcaatttgatcagtggaaatgcatggtgcgaaaagttatgatttgtcccaggttgcctacctagcatggaagacatcctgaacacaagacttcagatgacagctctgatgctctttccaatatcgttgcttaccgcagttggtcaacatgagcttggtttgagaaaggagcaacagaaaagtttttggggaacatttctaaatcattgctttcatttccagcactctgaccctatatcttttgtaggcaaaataataacaatcgcctttttttttttaaattggtagagagaaggaagtcataatattcacatagatattagctatttactaacttgtgcctcggcataatttttcttatacttgaatgattagagaataactgtcctcaaaaacataaaatggaaagttacattactttatgttatggatgcctcatctataaagacgtgactaccagtgattcctaaagacttatagagagttataagtgaagtcatattccaaagcctctgctgtttgggatttttttataggtcactgtcatgtagtgatatgaaataaaaatatttaactatccgcctctttccattcatcactgcactgccgcaagtgagggctttatggagataaacgatctggctttgaacacacacctggcaagtcacaatggtaaaatgtcgaccctttctgagaagtgaagtgtaagcagttctgagcagacccaccagctacgatgctgcacatttggttgtttctcttttaaaaataaactcagtctgaaagtttaaattatgtatagtttgtatagtggcttacatacaactgtaagaatgatcaaaggaaaaaaggacaaggtttgtatatctgcatattaatgttttaattttaaaaacaggtagccctaaattaacataagatgtttccacaatgtttttaactgactgaattctgtgggcaaaatgtatgtgtgtgtctgtgtgtgtgtgtttgtgtttgtgtgcttgtggtgtgtactacctgaaacgaaagttggtccaataaaatgaagttaatatctttaaaaatttggaataaattcagaaatgttctatatatactccagacatttaagtaaagtggtatttaaagtcctccttacagttatcaagtctggaactggtggagcagtatgcatctctgaccattacatctaatgaatcaccaagttctattgacaatacatccaaaatatattccaaatctgctcactgctctccttcacagccgacatgagcgcattagccactgtcagcatctcattaggagtaccgaagttgcttcttaattgttctttcacatctacacttgctcccttctgattaatttggcccaaagcaaccagaatgacctttctaaagcgtaatatggaccatggcaccatgctttttaaaatccttcccatgtctttccattgtacttggaataaaatttcaaattctaaacacgaaacataaggtccagtgtgacttgccctctcctcccctcatctttactttcaccaccttctctcatcccatcttttctaagctccaagaacacccctccatgcatcaaacttttcccaactaaagctttcacacatggtctttactatttctggaatgttctttttttttttttttttgagatgaagtcttgctctgttgcccaggctggagtgcagtggtgcggtctcggctcactgcaacctccacctccagggtttaagcgattctcctgcctcagcctcccgagtagctgggattttcccataccttcatatggcaattttttattcagtatgcagttctaagcttaaatatcaaatcctcaatgagtctttccatgatttccccaaagtatcctggttattcgctgtcttagcattctgtttcttttcactgtaaccacagtcatatatgtaactctggaataactttgtgcatggttttgtgcatggtatatacccagtggctagttcagtgctgaggacaaaaggagggaaggagtgaaggaaggaagaacagaaggatagaaggatagaaggaagggagggagggagggaggaaggaaggaaggaaagacagaaggaaggaagttgccagttcttcttcccaaaggcaaccaggattgcaattgcatgccaaaatttaattgttctaatgatttctgaactggttttgcagtgtttgtttgtttcgctttgttattctaaaccttggctttcgtcaacattagaaggaaggaattaagaaaggaagaatagaagttagaagtgggaagttcctgcatttaggattctaattctaaacttatttcttttatttttattagttctccatacagagagtagccctgtatacaacaatcattcctaacttgataactgaacataggccaatagttttcagtcttccatataaagttaaggcaaatattacgtgtacataacagaacctattaaaatagtcaaatctattatgtagcataagattatgtatctgtttatttgatttgactttttaaaaattaattcatcttttttaacaggtaatgctcttgcatggaacataattcaaaaattatgaaaggatttacaatgaaaagtctatgtgccaaccccagctactcagtttttctccacaaaagcaaccaggatttacaattgcatgccaaattttaattttgttttaatgatttctgaactggtttagtagtttgtttgtttttgtttattttgctttgttattttaatcattggcttttgtcaacattggaatagttgccttaatggtaactactattacataactcatgtgagtggaacacgtgtggttataagaattgtccagcatgctggattctattacacagttatttcatttccaaatatttgtctttcttgtaaaacagtcattatcaaatgactttgcttttacagccaaatgaggagacagttcttggatttaaagaactttgttacaatgattactcaagtacttagcagaaaatttttcaagcttttattccaaagactctcttttagaaaccccagccagaaattccaaattttcccagtgcataagtcacatcatggcaaattaggtcttcactttctcttttctgtaaaaagttactaactccctaatcaagactttgttctgacgttttgattggtctggccttttcaagtagattaaatgttattgattttaaaaatagttttcaacagattctttgtgagtggctacttctagactggcctaaagagaaaggatgacttcactcaaaagttcataaaaggagaatactgacagtcagcctttttgttcataagttgatttttaaaaatagaaatatggtaggacaaattgttgaattatttctttttactggaggctgtgggtatagtgatgaatcttcaagttggaagaatcaagaaacaagcattctgttgtccatacttggtatctctttttgtgatcttgtgttattcagttgacccattggtgcctctgttttctcttctttaaaacaagaggcatgaaccagattatctcttagaaactcccaggtttaaaatcctattgaatgaaaaaaaaagaaagaatgaactaaagccaaaaatttttaataagtttgaggcaaaagactggtttgcttttcccttatttgatatgaaatgcacatcatacaattaatattttgatctcactagagtctaatagaaattacagtatcacatcttgtcaaacacagaatcttggcttcacagtaattcagaggtcaattatttatacaaatggagttcaagttatagatttaattttcagaccaaaagtttctcacattaaaacccacttgcttcagttcattttgcagatacgaaatatgttttcttggtattatgaatctcttgttttaccctctgtttcattatgtaatcaatggatgtgaaaaatgaaggtgtcatgaaatgtcagaatctttaaaaaaatcttcaaaattatttaactgctatttaattgaagaagtttttcataggtattgtattaaattatatttatttatatctcatcagagtaacagtattacagctctgccggaagcttatattgaaagagaaatcacataaattctcatgtagcatatttgtaaagaaagaatatgttgacaactttctttttggtgacacgtcaggagttgtgagggattgaactgcctgcaattattgtttaactacatgaaattaccatttaaaaactgtccactaaaaaaataccaaataaatttgtagactcatagcaggagacattatactttattttttaaaatagctgaacttttggtaagacggaaaattccatgatttgccataaatgtataatttatctatagagaataattgtatttggatatagtaataaactctttatggagtgtgctgaatctacaaactttcaggaactttgattacaaggaccatcagagaaaggagaactgaaattttacgttacaaaattgctctacccaaattttcaatcaattgttagaataagttcaatgttgggtcatttttgtattttatgcttcaaagaaaatgaccattcagtgattcatctgggggcagaatatcagagtggttaagaagatggggtctggagccagaccacttggtttcaaaatgtggcagtgtgttttaagaaaattactttaataccttgatgttcaatgcatccatcttgaaaatgttggtagccttcatatttaacttatgggattgttgagaagataaaataggcgaatatgaataaagatggaagacctacaacagtgtcaacatctcaagaaatgttagttgttgctgttgttgtttttattagtattattcaagaggatgtgaaaattgaagttttgtctgatgtgccaataccgtatatgataattgtcatatattcaagagagtatgagactgaatagctgggaggaagcttcaaagtggataactcaaaagaatcttcatgtctttgaagacttcacccactttgagaatataaacgaatctagaatggagaggcagagggggctggccaaatttgttgagaaagagctgctgcagtgtatcccatatccttcaggtggggtgaggcagaccttttacacctgacctccaaagggtggagaagtcagtgggaccactcagagaggttaatgagcagtgtactgatgcctcatttatacctgtgagagttaaagcatgtatgaacaaggggaagagagagaaagagtgagaataaagggccacaaaatgatatccctgagggctagaggaaggcaagaggagtaaaagaaagcatgagtgtttctcacagagtaaatgtgagccacagggaaaaaaagaccatctggagacattttaagaccttcctggccaggcgcggtggctcatgcctgtaatcccagcactttgggaggccgaggtaggcggatcacctgtggtcaggagttcgagaccagcctggccagcatggcgaaaccccagtgctactaaaaatacaaaacctagctgggcgtggtggtgtacacctgtaatcccagctactctggaggctgaggcaagagaatcacttgaacccggggacggaggttgcagtgagccgagattgcgccactgcactccagcctcggcaacagggcgagactctgtcaaaaaaaaaaaaaaaaaccttcctaggaatagactctccaggtaatgtgggtccttagagatgctagttctaaggagacagtgaccatccaaatgggaggctcacacaatcacaggagttgggtgcaagctggggaccaatgacaaacccacagaagtacccagcagtgaaagatttatttgtagacatttgccgttcaccaaccaaataagaatagttttgccattatgtctctttctttactcctccctgcctctgtgttcctaagtgtggatatgacagggcggggaagctggtggtctaggtgacccattataaggtgtatcaaggacaaagggagatctctgagctttgactgacaattgaaatgttcatttgcgtgatcttagactggacactacagtgctacttataccttaaagtctggctggctatagagcatggaatcatgggaatttctgagttttcttcaagtgacatgggcagtttatccccattgactaaaactaatccttaaaaggaaagaagcccaaagttcccataagtttgaaatgcttatgctgttctgctggtttgttacaacaaaagaaaaagcaatcataaactgcatatacagagcacatgaataaatgggaaggatcctggcctaatacagcattactaaactaaatgctcatatgattcagtgcctaggctaccacatgaattaaaaatgaccttatgtaatgaattaatttccaaaataaatagaacaaagagaaaatcatcttagcatcttcttaccttaaatgagtatcggagaggtcaataataagacatgacattgtttccaaattattaaaatgatttgaaaatatatttcataaattgtaattataagtaataataatgtgcaaactctctactggattttatatatacgcactgtgttcaacattttaactattattttctgtcctgtttttgaaagttagatccaaaaatgcagtattgattcagatagaacataccgaaaaatatttattggttgatgatagcactggttcttgcacatggaatatatattttattttattaattattttcatttgtttatttatttattttttgagacagagtctcactctgtctcccaggccagagtgcggtggcgtgatctccgctcactgcaagctccgcctcccgggttcacaccattctcctgccttagcctcccaagtagctgggactacaggcgcccgccaccacgccctgctaattttttgtattttttagtagagacggggtttcaccttgtttgccaggatggtctcgatctcctgacctcatgatctgcctgccttggcctcccaaagtgctgggattacaggcgtgagccaccgcgcccagaatatatattttaatactaagttttgatttatttttgcttgattttaaatgaggcagaaatatggaattcatatacttgcttgtagataaaacatgttccactttaaaaccatgaaacgaagtttactttctttggggatattttaagtgttgaacctagaactctaaatcttgagggtcataaatatcagtcaaaaatattttcattataaataattatcttcagaaatactcttaatatcagactttttaaaaactaacaatgctagttttatggtgtcaaattttgtatttttaattttttttaagggacagggtcttgctcaggttagagtgcagtggcataatcatagcttactgcgacttcaaactcctaggctcaagcgatcctcccacctcagccttccaagtagctattactacaggcacgcactataatacctggctaatttttattttatttttttttggtggagagggagtcttgctatattgcccaggctggtctcaatttcctgtcctcaaggaatcctcctgcctcggcctcccaatgtgctggaattacagatgtgacccacagtgcctagcctgtctttttaatgtcaattatagatatcttaaaagaagtttcctattacattttaataaaatgcattatttattaattagtgcttgagggatacaatattgatattgtctgttggaaggccgactaacatgttaaaagatagtaatagaaaacctatggcagggtgcggtggctcacgcctgtaatcccagcactttgggaggctgagtcaggcagatctcttgaggtcaggagtttgagaccagcctagccaacgtgacaaaaccctgtctttactaaaaatacaagaattagctgggcatggtggcgcgtgactgtaatcccagatactcaggagactgaggcaggagaattgcttgaacccgggagacagaggttgcagtgagccgagatggcgccactgcactccagcctgggtgacagagtgagactccatctcaaaaggaaaagaaaaaaaagaaatagaaaacctattttagaactacagaaatttcacccaggttgaactaaatctagcttacttttccttaatgtactataagagaaattttgttcaaaaaataataggttctcttttattatatattacattgtcttatcttctttgatccaacttttcatataacttaattgcagttaaaccttattgcggttccatgaccatagaattctacctttcaatttttttaatttttttatttttataaatttaggggatagaagtacagttttattacatggatatattgcatagtggtaaagtctgggcttctggtatagccttcagccaaatagtgagcattgtaccctatatagcctccacatattaaattcatcgttcaatattaataaatttactatgaacttgttaatcacttttagaagaaccaatatttaaaaacccaactgtaaagaatgatagaactgtaaagtaataataatgagcaactgtgctttatacactatttcgtgtctattacttctttttttgtttgtttgttttgagacagagtcttgctgtgtcgcccaggctggagtacagtggcacaatcttggctcactgaaacctctgcctcctgggtttgagtgattctcgttcctcagcctcccaagtagccgggattacaggcgcccaccaccacacccaactaatttttgtatttttagtagagatggggcttcaccatgttggccaggctggccttaaactcctgagcgcaagtgttcagcctgccttggcctcccaaagtgttgggattacaggcatgagccaccatgcctattgtctattacttcatttgaccaactttggccctcctcctagccccatatggcaggcattttcataatcccattttacaaatgagcagactaacattcacagtcattacgatactttcccaaagccatgtagctagtggacggtggagcatacactgagactctgttctgcggaaacctgtccataacatcccttccttgctagcaatatatttatagtgagaaaacatggacttgagcttcagatttagtacttgatacctatgtggaattagagccacgtttttaacattaggtcctccccttgtaatatggagatgaaataagaatttctttgggttcttgttaacgaataaacaagttaatgtattttttaaagcactttgtattagtccattttcatgctgctgacaaagacgtaccctaaactggacaatttacaaaagcaaaagatttaaaggacttaaagttccacatggctggtgaggcctcacaatcatggcagaaggcaaggaggagcaagtcacatcttacgtggatggcagcaggcaaggagagagctggtgcagagaaactcccgtttttaaaaccatcggatcttgtgagacccattcagtatcacgagaacagcatgggaaagacccgcccacatgattcagtcatctcccaccgggtccctcccacaacatgtgggaattatgggagctacaagatgagatttggctggggacattgaaccaaatcatatcattctgcccctggcccctcctaaatctcatatattcacattttaaaagcaatcatgccttcctaacagtcccccaaagtcttaactcattccaactttaactcagaagtccacagtccaatgtctcatctgagacaaggcaagtctcttccacctatgagcctgtaaaatcaaaagcaagttagttacttcctggatacagtgggggtacaggcattgggtaaattcagccattccaaatgggggaaattgaccaaaacaaaggggctacaggcctcatgcaagtctgaaatacagcacggcagtcaaatcttaaagccccaaaatgatctcctttgactccatatctcacatccaggtcatgctgatgcaaaagatgggccaaatacttagagccaactgattgtttgacaaacccaacaaaaatatcaagtggggaaaggacaccctatttaacaaatggtgctgggataattggaagccacatgtagaagaatgaaactggatcctcatctctcactttatacaaaaatcaactcaagatggatcaaagacttaagacctgaaaccataaagattctagaagataacaccagaaaaacccttctagacattggcttaggaaaagacttcatgaccatgaacccaaaagcaaatgtaaaaaaaacaaagataaacagatggacttacataaatgaaaaagcttctgcacagcaaaagaaaaaatcagcagagttaacagacaacccgcagagtgggagaaaatcttcacaatctatatatgcaacaaaggactgatatccagaatctgcaaagaactcaaacaaatcagcgagaaaaaaataatcccatcaaaaagtgggctaaggacatgagtagacaattctcaaaggaagatacacaaatggccaacaagcatatggaaaaatgctcaacatcactagttctcagggaaatgcaaattaaaaccacaatgcagtaccatctcactcctgcaggaatgttcataaacaaaaaaataaaaaaaaaatagttgttggcattgatatggtgaaagggaacacttttatgctattggtgggaatgtaaactagtacaaccgctatggaaaacagtgtagagatttcttaaagaaccaaaagtagatcttttgatccagcattctcactactaggtatgtacccagaggaaaataagtaattatatgaaaaaaagatacctgcacatgcatgtttatagcagcacaatttgcagttgcaaaaatatggaaccagcccaaatgcccatcaatcaacaagtggataaagaaaatgtggtatatgtatgctatagaatactactcagctctaaaaaggaatgaaacagtggcatttgtagcaacctggatggaattggaaactattattctaagtgaagtaactcaggaatggaaaaccatacatcctatgttctcattcgtatgtgggaactaagctatgaggacgcaaaggcataagaatgatacattggactttggggactcggagaaagggtgggggttggtgaggaataaaatactacacactgggtacaggatacattgcttcagtgatgggtccaccaaagtgatgggtgactcagaagtcacctctataggatttatgtaaccaaacactacctgttccccagaaacctattgaaataataaaataaaataaaataaaataaaataaatatataacaggaaaaaaaattgctttttttcccagttacaaatatactcacatatattttaaattttctaaattcttcttttcactctgagcttttctatgtaagatttatttttgtgtctagtgtagaaatatactttttattgattttaagtgacaaataataattgtgtatatttttgaactataatgggatgttttgatctatgtatacattgtacaaagagtcactcaagctaataaacatatccatcttttcatcaatttaccatactattgtggcaagaacattaaaaatctattccgtctgccagtttccagtttgaaatacacactacattattaactgtggtcaccgtagagtgcaataaataactaaaacttttcctccaatttaacagaaattttattacctcctgcccccctctgcagcctctggcaaccacctttctactctgtttctataaaatcaactgttttagattctgtgtgtgaggtcgtatagtatttgtctttctgtgaatggcttacttcacttagcataatgtcttccagttcaatctatatagttgcaaatggtagattttttaaaggccgtataatattccattgtgtatatataccacattatctttatccattcatctgttgatggacacttagtttggttccatatgttggctactgtgagtaatgctgaaataaacatgggagtgcagatagctcttcaacatgccaatttcaattccttgggaaatatacccagaagtgggattgttagattatatggtaattatatttttagttttttgataaacctctatactatttccaaaattactgcactagtttacattcctgccaacggtgtacaagggttgtcttttatccacacacttgccaacacttgttatcattcctcttttgataatactcattctaacaggtgtgaggtgttattccattgtggtttcaatttgcattttactagtgattagagatgttgagcatttatttcatgtatctgttggccatttgtatctcttcttttgataaatatttgttcagatcctttgtccatattttaattgggttatttgttttcctgctgttgagttgtttgagttccttatatatttgggatattagcctgttattagatgtatggtttgatgcaatcctatctgtcttgtttttgctttcgttacctgtgcttttgtagtcctatccaagaaatcattgcccagactgatgttgtggtgtttttcccctatgttttctgcaagtagctttagagtttcaggtcttacatttaagccttttgttcattttgagttgagttatgtatatggtgtgacatatacggtgttcagtttcattcttctacatgtggatatccagtttttccaacactattttttttggagaaatcgccatttccccattgtgttttcttagcacctttttgaaaatcaattgttcataaatatatgggtttgtttctgggctttctatcctgttccattggtcgatgtgtctctttttttgttttgttttgttttgttttgtcgggaccatactgttttgattacaatagctctgtaagatattttgaaatcagggagtgtgatgcctccagtgttggtctttttgctcatgtttgcttttgctttttggagtctttgctggttccatatgaattttaggattgctttttctatttctgtgaaaaataacattggaatttcgataagtacaccaaggaatctgtagatcactttgggtagtatggacattttaacaatattaaatcttccaatctatgaacatgtgatatctttccatttatttgtgtattcttcaatttctttcattcatgttttacagttttcagtgtacagatctttcacctctttggtgaatttacttctaagtattttactgtttttattgctattaaatgaaattattaatttctttttcagatagctcattgttactgcatagcaatgcaacagatttttgtatgttgactttataacccacaactttactgaatttaagtatctcgattctaatagattttggtggaatatttctttaaggttttccatatataagatcatgtcatcagcaaacagactatttcacttcttctgttctcatattgatgccttttatttatctctcttggctaattgccccaggtaggattttcagcatcatgttacatacaagtagcaagagttggcatccttgtcttgttcttgatctttgagaataagctttcaattttttatcattaggataatgttagccgtgggtgtgtcatatatggcctttattgtgttgagattcatttcttctatatctactttgttgagtttttttttttaaccatgaaaggatgttgaattttctcaaatgttttttctacatctattgagatgattatatgatttttttgttgttcgttttgttaatatgatatatcacatttattgatttacatgatttttaatttacatatgttgaaccatcctttcatccctgggaaaattcccacttgatcatggtgaagtagtaatacgtctttgtattttatatatatacacacatacatatatgtgtgtgtgtatatatatatatataatatatatataatgttttgttctagaaacttttattgaatagtttatcttttcttcccttatttttgtgacatttttaacacttaagtttccatgtgtggatctgatcttagattactaaatttattttattggtctatttgttcctgtatgtataccttactatatttactaacaaacagttttataaaagaaatttatggaaatcttgttatctgctagataacctcttgtttgttatcttaaatttatgttctattcttgactttgctattaagtgtgaatcttcggatctgtttatcaaaatctgtgaaaattcctactgaaatttattttttaaaaattgattccaatttatagataagtttagagaatcatcacctttatctttataattctgagtctttttatccatgagcatggtgtgtgtgtgtgtgtgtgtgtgtatacacacacacacacacacacagatatatattttcccattatttaggcctctttacatcttttaatattttttaggtttaaacttctcattcagttaatcaggtcctttttttttcttttctttttttttttgagatggagtttcattcttgttgcccaggctggagtgcaatggcgtgatctcagctcaccataacttctgcctcccgggttcaagtgattctcctgtcccagcctcctgagtagctgggattaccgccatgcgccaccagtcccggctaattttgtatttttagtagagacagggtttctctatgttggtcaggctggtcttgaactcccgacctcaagtgatctgcctgcctgggccttccaaagtgctgggattacaggtgtgagccaccgcgcctagccaggtcctcatttcttcatgtgtgaattgaaaataattattttttctctgtatatttacagatataaatttgaagataaaattaaatgatgcttatgaaccaattacataaataataaggttttgtgtttattattttttaaacagaggtatgggtgtattttatgcttaatagtacatcatgattatctagattctatttaattattctctttccccccagtgtaaaagttaggatcttataattatttaaggtaattgttattcttcaacattaagaaaatcattgttgtgtttaatgatgtctggaatgctcagtaaaccatgattttttattaatcttatgcagtctttgattaatgagaaatataaacgatcatttagtcaattatttattatatcacctactaggttgctaagcactgaatcagttttaagatagttgtcttcattcagggaacaaaataaaagatggtaagaagttttgagggcccagtactgatcaatgttcttttaagtttagcagtctacagactttactaaatgtggaagttttaaacattattttattattgctgtttttttggagaaaaaaatgattccaaattttcttcttttttttttttgtggttgtaagtgacgtgaaactataggatttatttttccattggcttcttttaattaaacattttaataacatgtattatccaaaacttgctataccaactatgtaatcacctcttccttctatttttatgaatatactatctgacgactaaggtgatatcagaaaattttcactcaaatgaataaaaaaaagaatgacaatgaattgaatgtatatgcttcagtagataatttataaagaaaatttaatactctaggaatgatgctatacaagctggcgtgtcaaataataaataattttaaaataggacaaggaccttcatacactgaggaatgatataaaaatacaaaaatattttaattgtttaaaataagaacttaaatctaaaggagatacttatgatgtctaaatatgaaattctatactcaggttgaaaaattatattctataaaggcagactgaagtatattaatattgttagcagttagttgatggtgaccgtatgtaagttactgtgttgagttaaatattttatgactatgtagcccatatgaatggaagacatttgagtaaaaagagtatatttcttgtggagtctacattggtgcattgtggtaaaatataagaactactttttaagaggggcattgattaatcaaactgcattctgacataagtaactgggttgataaaaacaatctgaaaactctcacatgaaaatggattgaagggctagaagatattacactgaaaagataaatctggtgcaatggacaaatcagtttgaatacttgagtagttgttatatatgggaccaaattaagttttatttactccagaagaaccactaaactgttaaagggcaggtttcatttcaaacaaatttttttagccaattaaattatctaaatttggtaaagtctcatttgtaattagtagaggagcttcctaatttgagtagaagactgaactaggtaactgtcagccattatttaacaaatatttatgaagtacatacaatatacaaggtgttaaaaaattataaagaaagatcactgatccttaatggtatgtgattatagattttaatctataaaggaaatgtttcttgtagctatttgatacatataaagtttagagtaacttcgtaataattaatacattgcatatatcaaatagtgatcagtgtatactaattatacagttctccaccaagtagggtaggtacagacatgagaagacaagacttgattaaattttaaaaatggattcagtaattggattaatttgtttagagcaaaggattttcttaggtggaaaatgagaaaaatgatctaatgaagttgtgcttcaagagaaacaaagtgaaagagagctggagtcccagtgtgacccctagaccagaagcatcacctgggaatttgttaaaaatgcaaattcctgggtcccactccagacctactgaatcaaaaactcagtgttggcggggtggagtagcaaggtgtggtttaacaagcccttcaggtgactgtgattcatactaaatttgaacagcagtgtagactgctgttgttgtgaagaggagtttacatatgatttgtttagatataatttggaaggcaattcatggtcactgcacatcagtggaaataaaggatgcagatgctatggcttcaagtagtaatatattgactaacttatgtaatgcataactctagagaacattttaaatagcacagtgttgaaacatttgaaacaaatttattgatatagttttttttaagttaagttttacatctaacatttaaaatgatagaactaggtatagctggaaacaatgcctgtttattttcttacacagagaatgaattctttcttcccttaaaacagtgttgggtaatgttccagaaaagtaattacaggccagttagtaaatatacgctgagatagtagaatgccagatagcaacagctatatgtctgccactactggttaatcagctacagaacagactgattttttgacttaatatggcatagggactccattaaggacagaatctgcatcttaattactgaacatatcccccccactgttttcatctgtatttacgtatgttttctttttttgttgtctaatagaagacaatcagggttgtgcacgatttacaaattgcttcttcacctcctgtcttcctcttctattcaataggcttgtcaagctataagagattatgaaatttggggtagttagaaatcacagccaattcaatctcatttccacacaaaccaaagagtaataaattactttattgtagcagcttattgctttgaacctaaattacagaaaaatagcttggaaattccgtaacaaagatgaaatagtctatttgtgtaggcatacttcttacagtttgtgttaactctcagctctagcacattttatatgatatttggatatattggtttggaaggagacagtcatgatctgatggtctttctgattttgtttctctctaaccttaattgctgaacctattaaaaaccccattttaggtttagctgccttagattctaggattattcatgtgctaggtcaggaaaatacagaagctctatgtctggaaatggaagagttgccattgactcaaccttgctgcttatcctcttcttaccttgtatttctgttctgataattcaattcttgccttgtcactgatgatcaggactttccctcatactcaacaattgctctagagctctgctttgattctcagccttctcctctgttcatttcaaaaacagggaattattttcataatcttcaatctttctgtctccccagacacactgaccacatgtctatccaaacaggtatcagatcatcctctttccaggtaatctgatttgattttcctcatatacctcggggcatcctgctttgggatgtgaaggatttgtgtaaacatcttttgttgactgtttgttagaaaatttcttcattgccagctattggtaccctgctcagatgttcttaaccttcaagcacgcctatttttccagctgctaggagttttgggttataactcacagctaccaccatcacaacccctttctctggagtattatcttaggccagtggtcctaaaacattagctttcatctgaatcacctagggggcttattaaaacaaaagactggactcagagtttctgatttagtaagtctagggtggggcaagagaagttgtattcctaacaacttccaaagtgatgctaatgctgttgctctagataacacatttcaagggccattcctctaatctaaataggagcttattattccctgaaggctctttgtcctgtctctcctcagggtagaccacagtgagtgactgattgccacaagcttatacaagttggacctcttacctcaaagtgtaactatctacattgtttcatttgtgtttgaaagctgcctagtgggatcagaattaaagggtcaccatcagtaatgatattctggctaagcattcttttctaccctatcctgcttcttccactctccttctcctgaaagtactctcccaataaattacttaaataaaatctccatctcagaccatacttctaggagacgtgatatgagacttatacctgtggatctatggtttctggtctctttaattcaatctatctattcaataaacttgcattgaatgtctttgaatgtcccagaaagcatatggtatatggaagataattaagatccagtttctttaccaagcaacccaccatttggttcaagggtagataagcaaatgtacaattatagcagcatgattgatactatgctacctcagtgctgataatttgaggtcctgactgctttcatctgagctttggagagtgtcacatgcttgattctctgggacagagtctctgagatggagatttgtggatagaaggtttatggggaatattcttagagataccagtgaggaagtgagggaaacataattgtgcaaatggagaggctgggtgagagctcaggtgaaactgggaggggctctggagatggaatgtcccttcaaatttgtccagaattaaggaaagagatcgatcactagatgcaggctgcccagtaagaggagcataacattggaagaaataactctctttggctgagagatgcttgaagaggatacatacaatacacacaataaaagttggtccctggagagccttgcttgtgatcatctcagtaatatatactggcttcccaccagaaaaccatttatcctattcctcccaacaggaattttaattgagtttgctcttaagcactaaatttctcagatatcccaaatgctaaatgcaagccaaacctgagatttcctgaaaatatatcctgtagacagatgtgagagtgtttcaaaccttattgaaattactctgaggagcaatgcagcaggtaacaaatctgacacacagcaatctttagaataaacatatgcaggcccagagttcagaggctaaagtcaatttaatgagaaagctgtcactattcttttttacatgaattaaacgtattccaagttgcccaagtcacggcctaacagtaaagagtctggctgcagagctgagcatttgttttatgttgttctcagggtcacttaaaaatgaatgtgagttacctggattgaacagaattctatttagtgtattctaatatgtggtgataaaacttgggaacctcagtaaagggaactgatttgaatgtaaaattgtttattttgaagtacatgtatgccaaacactgaaattttctattgatattgaatatctatcaatattcaatattttccattaattctgttgattctatttgctattgaatattgatataacaccatttagtttgtaaagagaaatataaaatcttaatgaataaagggaaaactattgataagtcttcatagagttaattatacactcttaagacattagactcaagtaacttcatacctactgagaataaatgctggaaaaatttacaagttttattttccatatttagtgccagagagccagattacacacacacacacacacacacacacacacacacgaacaagaataaataggttcacatgtttccttgcagtaaagtctgtcctgatgggatggactctgacaatattatgaatgagtatgaaataatagcaaacttggcctctagaaacaatcttccctctgaaatgcgtgttttaaattacctcatggcaaggccagtgacattcaaggattgggaatgaggttagaaaaatggaaatgattctccacttctgggaaggtcttttgcctgattaacgttatgtaaacattttgctgaagaaagaataattctgcactttagccaccaaatcattatagaaaaacaatccagttttatgcctcctgtgctccagtccaagggtcagcaaactatggcccttgagccaaatcctgcttaccacttatttttgtaaatacgtttctattggaacacagctctgctaatttgtttacatattgtctatggctatttttgagctgccatggcatggttgagaagtgcaaccaaaaccatatggcccacaaaacctaaaatatttactatctagccatttacagaaaaattttgctgatccttgctctattgtgttttagttctgtgtatcccaggtttactgataagaattacctggagtgcctttcaaccaacagcttcttgatctcctcctttggagattctgattcggtgaatctgaatgagacccagaaatttctacctttagcaagtactggaactttgggaaataccaagctagttatttgactctccaatattctagcataccattttttatgttcaaaaagtccacattcttttcttcaaattcttcctcatctccccacataaatgcaaggtatggacgaatgtattgtacaggattgtcacggataaggtcggctagaagcagtttgtgataatgattagggtgtatgttgtttgttgagggagtactctcaggagtaaggaagttatagaagcagtataggaaagggcgataaagctacagaatgtgctctcattacacatacaccatggaatactatgcagctataaaaaaggatgggttcatgtccttcgcagggacatggatgaagctggaaaccatcattctcagcaaactatcacaagatcagaaacccaaacaccacatgttctcactcataagtgggagttaaacagtgagaacacatggtcacagggaggggaacatcacacaccggggcctgtttggggggtgggggactaggggagggataacattaggagaaatacctaatgtaggtgacgggttgatgggtgcagctaaccaccagggtacatgtatacctatgtaacaaaactgcatgttccgcacatgtaacccagaagctaaagtattaaaaaaaaaaaaaaaaaaagaatgtgctctcagctggagacatgcttcagtctgatcccatggggacctctgcagcataaattgaaccacagagttgatcctgccttcaggcaagagggctggccttttgagcactctcttcccattgccatcagttagttatttggatgcagggagtccttgaacaggggacagacattagcagcaatcattgaggcacaagtacacctgtggtaaaggcagaggaggggagaagtatagcatctggtgcagaagttatacccccaaatgaatgaaatttagacttggaatgtgccctgaagaaagacctatctacaagagtctttaaaagataattttgaaatatgttttcaagttagtaacccttcggaagtcacaaatatatttgctagaactgatacctatcatctttgaaaagtaagaggaaaatatgtatcagagagaagtgacttttccggttaataatcattgcttgttgatacgtgcttttgactaggtatttagtaagatcttttggttatgtttacctccattaggatgatatgagttccttatgaatttaaatgcatgtgaacatttcagagtcccacctggaatgcgactactgtcagacaatgtattctctctagcccctaacatttcatgatagattcactacagttgtagaagaatccttcaataaaagttatgttatgggaatgtaaaacaaagtttaaccttccataattatgatttactttccaaggaataatcatacctaccactacttgcttatcctcccaacctgcaaggtaggcatcaattacccaatccttacccaaagtcacatgtctagccaatggtggtgtcgaatattctgatgaaagagttctattggccccgctaaagagttgtggggttttttaaatctttaactcaagttgtttcagtgaacctagaactaagactttttcaaccactcccaaattattgatgcttgggttttgcaacaaatgccctctaagctctcaggataagttgggggaggaaaatgaaaacataatagggtaagggttgttctctaactattcccagaccagttctcaccttcaaactgctctctctctctgaaagatgagcaaaaaaaaaaaaaaaaaaaaaaaaatgtgacctcacaaaaggttgtgtgacctcaaaacctgccaagagtcctcagtgcagcccactctgaagacagtggaacaactcaggaaagaaggtagagtattttatagaccctagagtcttatctcatcccattctgctttctgtcttcttgaggcacagttggcttaaccttttcttgaagtgaaaactatgtgaataagaatattaacccccaaacaacttaaaagcacagtcaaccgcttcatcactggtcattagagaaatgcaaatcaaaaccatgagataccatctcacgccagttagaatggcaatcattaaaaagtcaggaaacaacagatgctggagaggatgtggagaaataggaatgcttttacactgttggtgggagtgtaaattagttcaaccattgtggaagacagtgtggcgattcctcaaggatctagaaccagaaataccatttgacccagcaatcccattactgggtatatacccaaaggattataaattattctactataaagacacatgcacatgtatgtttactgcagcactattcacaatagcaaagacttggaaccaacccaaatgtccatcaatgatagactggattaagaaaatgtggcacatatacaccatgaaatactatgcagccataaaaaaggatgagttcatgtcctttgcaggaacatggatgaagctggaaaccatcattctcagcaaactaacacaggaacagaaacccaaacaccgcatgttctcactcataagtgggagttgaacaatgagaacacatggacacagggaggggaacatcacacactggggcctgttatggggtgggggtctaggggaggcatagcactaggagaaatacctaatgtagataacgggttgatgggtgcagcaaactaccatggcacatgtatacctatgtaacaaacctgcacgttctgcacatgtatcctagagcttaaagaagtataataaaaaataaattaaaaaaacaaacaaacagaaaaacagctgacaaaacagaattgcccagcgtaactgtatttttaagttagcagcaaaaatagaattttgattttatgtcatgtatattgggaaaaaggagcaaatgatatgatgtcagttaaaagaaaactagcatagttcaagattttcccatgattctcctatgaacttgaaattccaaaccaaacccagctgagtccaaagccagtagtgctcttatcaactttccatggcaatgtcttacaattctctttaggctagggccaggggaagaatccatggaattgaccacttggcaggacattaccaaggtaggggtggctatagagatttcagccgaaccaccctaggggatgaagcaagaacacaatgaccggggcagctccaggctcacctcctccatgaagcttttccttctctctctaggtagattaggtgactgccttcttggggaaacattaacatgggttagataatatgagctattcctatatggcaacaagctaggtgaggaaaatgaagatacgatgcatctatcccatctctccagcacccaggacagagccactatatcctggcatgctgtagcacagagtagagagccctgcagcatttaggcacattgaacatacttgttgatgatattctgagccctctttcctttaaatcattgttgagtattttctgggtcaactcacaatataaaacccctgtcataaacattcaaaaaacttgataagctaccagaaatgttcaattaaggaacaaaaagaaactgaagagcaacaatggacacctcccctcctgaactccaccagagaacttcagtccatttaaaagatgaagccagttttaatctataatttatgtcaaatttcactcttaagtcacaaggttaatatttttagtagaaaatgttgattataacagaaactcaggtatctcatatgcacatactcacggtatgattaaagataatcaggtacaattttactatgagattggacaatgtttgaagaatatcaatactgttttagtgaaaagcagatcaaagtatgaaattaaaaatatctttagaatagtaatacttaaaagaattcagtaattggaatgcttatccatgttttttaatcactctgttttaaatctgactttcagttgtttcaaaatgacaggttatgttgattaggtaaattatattagcatttatttgtatttaatttctacatttcctgttaccatctttttgcccacttttctattggtatgcaccttcttttttattgtatttatttaaggtatgcaacatggtgttttgatatacatgtacatagtgaaatgatcactatagtcaaccaaattaacatttaccttcccacatagttaccttttttgtggtaaaaagggcatgctcattcttatctttttgattcatataaatgtcttatatgtcacttatattagcactgcaatacaaatggttgttttaaattgatcttctgccttaaaactttacttgaaaaattaattaaaatacttttttcagataaattctgtctttgaatgtctgtttcagaaaggtcatatttatccaagaggagacaaatagccacctacattttctcccagtgctcttaaaattaactgcaatatatctgaatcttttgtggcaagattatctttttccttctgtttttctcaaatgagtaacacatttttaacccaattttgagtgataaatcttttttgcattgttttgagatgctatttatagtatgtaacaaattcttacgtatgcttgatatgcttctagactttctcctattttgacatctctgttcttttttcaacaccacatcaggaccattcttttcgtgattattacctcgatttacattgtgatatctgctgcttcaggcctattcaaactttcttgacgatccttgcacatttaattcctctagactattttggcatgagtctaataatgtcattgggatctttattgagattacattaaaatattttgattaatttaggaacagctggcagttttacaatattaattttccattcagaacatatgctttctctatttttcgaggcttttaaaacatttctcactgtaaattgttatagttttcttaatgcagatcttgcacatttcttataaagtttattcttatgcattttataattttgttactgttgtaagtaagttttttggatcatatttctaatttttattcctgggcatataagaaagctatagctttatgtatacagtgtctattttcagactttttatcagaccggatagaatgaggatcttaccaatttcagtgtgggtataaatagaatattagcacacttgtacattccctatgattttttaaaacagtatttcctttgataatgagttattcctgagaactttacatataactctgcatgtttgttttgttttgttttgttttttgagaaagggtcttgctctatggcccaggctggtgtgcagtggtgcgatctcggctcactgcaacctgtgcctcccgggctcaagtgattctcgtgcctcagcctcccaagtagctgggattacaggcactcgccaccacgcctggcttatttttgtatttttagtagagacggggtttcgccatgttggccaggctggtctcgaactcctggcctcaggtgatctggccaccttggcctcccaaagtgcagggattacaggtgtgagccactgtgcccggcgtctgcatgtctttttgtgaatgatttactttacttcccatctgtggctgatgggacaaaagaaaaattaagagcaatgtgattaatgctaagattgaccaacagtttttagaaaattaaactgcttccacatgagataattcatgttttctagatactttatcttccaacaagtggtaagtaatgaagtagataaacttcgttgtcactatgtttatatttcaagttttctgaatgaggcaggcggtgtaatgtgtatatattattattattgtttttatttttgagacacagtctcgctgtgttgcccaggctggagtacagtggtgtgatctgagctcactgcaacctccagctcctgggttcaaatgattcccctgcctcagtctcccaagtagctgggattacagatgtgcaccaccatgcccagctaagttttgtatttttagtagagatggggtttcaccatgttggccaggctggtctcgaactcctaacctcaggtgatctgcctgcctggggctcccaacgtgctgggattacaggcgtgagccaccatgcctggccaatatgtatatactattaattaatatgaagatattgttatgcttggatgacacccttcctgttgctgaggcaggagttacaaataaaacatagctcttcggtctgctcccagatcctcctcactgtactcttgctcacattttgtccctgacagatgcctaagggccactgaccactccctcaggaaatctctgtagctatacaagcagcaggcatagaaagaaatgaattgtaagctattcttctagcactctaattagacttttcagtctaattgcaggagatgaaattgaggcagatcaaattctcaggatgactagatttgagaatcattacaaagtaatacattgacaattacaaagctagcatgctcctgagagtagaactgaaccttcctcagcctcagagtatcagatgtgaataagaatatctcatcaacttgtttcacatgcttgtccacttgttttaaaggagaaaatgcaaataaatatgctgcaaggcagtctaggtaataattatttacactctagagacagacctggcttcaaatcttgacatgtaccacttattaacagcacgttgaaaaacacatttctttaatacctagagcctccacttctagccagaaaagttaagataattatagaacctactgaatatggttgttttgatgataaatgaaattatgtatgtatgaggtctatcctgacgccttatatatagtaagcatgacataatattatgtactgctactattgtatttgctaaatctccaattgttttaaagtataaaagagtattattattttattaaggacacagagtggtattctgagaggagtgggaatcctcaagagcttttttcctggaaattaattttgaaaagaagcttgatgaaaatcttgcatttagagtgaggaagacagtcaactctgaattacataattatatatatgtactggagacacagttcgttcctatgatataagaagggctgaaaaaaaaagttactcctttatttaatcttaaactgatctggtcttcttcatgagtcctcatccataaggaaattatatatatattccttatccaacagaggaaaaataaattctcattctggcttaatctgatcatttagggcacaatctctcataaaaaagacagcttagtctctctttcaccctccttctactgttacttgttgcaaataagatgatgttcctccattatatgaggtaaaggggatgcttcctaagccctcatggttgcaaggaaaaataagtgcccttgggtatcatgtcccttgttttctgagataatatcccttgttctctagtcactgataagcttgtcagctggtagaacacacgatcggcctcctaactagatcagtgcccaatatcattctctggttcagttagattcttcttaaattggaatgtctccagactcccaagtctctgctgtttcccattcagccctctggcccatggtccatctctggcatcctccactggggcaactagttttgccactgcaggtccaccacaaaccccttagcagtatctagctagaactcaacattcctaaagatgtgtgtgtgtatgagtgtgtatatccatctatatccatatctgtgtctatatactagactgtcaaaaaatttatatggtaacttttgttctacgacagctagggtacattgtgaaagtttcaaagcagagattatgtctcatttatttttagctttccagcacctcacctgatctctgatataagcaatcaatctgtattctcttcatgatgagaaatattctccattctcactgatagcagatttgtgaccactaaacacacacgcagtactggtgtgaacgcacaaactattgaaacaacaagcacgcaacaagcaaggaaattgtcactgctctataatttggtgatgagatatctggttactttcagacaaaagaaaatgtctcataataatagggttttgtatgattcttctctttcttccagaaataaaaaatttagaaacaaaacattgagggacattttaggttaattatgcattttagaagagttccccagatatcatttttgtctaatttatttttcaaattggcatataaaattatatgtatttatcttgtacaacataatgatttaaagcatatatacattttagaatggttaaatccagctaattaacaaatgcattatacctcacatagttatcattttgtggtgataacccttaacaccctggataacttttgattcagtttctgaacttgccatgtaaaattagtatttgtactcaatcagtttcttcagtttggagtatccttatagtgatcctgggcccaaactaaaagtgcatagggaaagtagcatagtctctttccatttgcctctagtcatttttatgtactgatgaacatgtaaatgctgctgtacaaagtacaagacagggatgaagaccctgttctcaaatatttccaggatagggagaggctttaattatattttttaaagattttctaaacagaagaaagaaaaatccccattgagaggggaggcagtggctcatgcctgtactcccagcactttgggagactgaggcaggaggatatcttgagtccaggagtttaggagttcaagaccaccttgggcaacagagtgagatctgatctctatagaaaataaaaataaaaaaagagaagggagtgcatggggaaaaagaaaacaataacaacaacaagaaattcagaagtggtttgatgtgttgaggttaaactgaaacaatgccttcattgcaatgagtgcctttgacgtctgtcaaaggtggtacagtcagtgacaatgactgcattctttctggctttgggttcacagtgctttgcagtgctgtgctattcagaactaaataactgttgtcactgctctataatttggcgatgatatctggttactttcagacaaaagaaaatgtctcataacaatggggttttgtatgattctgctctttcttccagaaatacaaaaaaaagacacatttaagaatttatctctgttcacattgaggaagaaaataagctttaaaaagttttactcctccctccctatagcaatgcttgcctgactttccatcgggggaaatgttactttcagcatattctgtgtgtgaaatagacagtgccagatgcttcaaatggtcataattgtgaaggatatgaaaaaagaggcatcttcctactgcgctttattaaatgtggagggaaaaaaaccctttgggtaaattagcacttggaggatttagcaaaagtgaattaactatgacagggtcccctaacacatctatttgatgatcttgcaagtcttattcccggttacctgggatactactttgctttgggatgccatggggtcattaaaatgtgagacaggttctctggaagagaaaaatcagatgaatcttgacttacagacagtatgtcttcctaaatagtatttcttttgactgaccatacctttcccttgatgctatatttctccctcatgcgctcatctgaacaaagaactgactgcgaatttcagctgccaaaaccaaaggacagttggaaaggctttttacaagcaattggcaagtgtgctctcaaaaactgaatatataggtgctgtttttctcttataaattagtattgaaatctagcctctattatgccatgggaatataaaaaggagaaatgaaggcagaagtatgtggtgactacattaaaaaaatgagtccactattcttattcttcttcttgttatttatttatttatttactttgagatggagtctcgctctgttgcccaggctggagtgcagtggcgcgatctcggctcactgcaagctccgcctcccgggttcacgccattctcctacctcagcctcccgagtagctgggactacaggcgcctgccaccacgcccagctaatttttgtatttttagtagagatggggtttcaccgtgttaaccaggatggtcttgatctcctgacctcatgatccacctgccttggccacccaaagtgctgggattacagacgtgagccaccgcacccagccgagtccactattctttcttttctttacacataattccaaaatcaaaaatagctccgagataccagatgtctttgtggtaactcattcaacccaacttgaatgtatttggtgcctgaaacttatctaacctaccgtgagattatctttatctctctcaatgtgactgttcatatgcttcactgcaaaaatattagtgtgtttgatgacaggggtgttgtagaccccactgggggtgctatagaatctgtgtagtgttacttctataaatctgacaaattctggattttagaacagaaaatattttgttacaagtgaggcactgtgctgctttacagactttatctcactgaagcctcacaacctcccccagacgtggacattgctctgatctctagtttatagatgaaaaatttaaggattcaaaggtgaaataagttgctcagagtcactcttctattatagttacgcactattgcataataaacatcccggaaatatagtgacttgaaacaacatgttattgttaacacacacttctgtggattgactcagctcagctgagtggttctgatatgtggctgctgtcagataggagctggggttggaatcatctgtaggattattggctcacatgcctatacctcagctggaataccttgaggctggtcaagcatgtctctctgcatgtggcctctctgcatggctatattattcctcccaacatggctgcctcagcatagtcagaagcagctcctagactagaacaagtgttccaggaagtggaacctgtcagtctattaaatcctgggctcagaaactggcatggtgtcatgtctacgtttttcgatgggtagaaatagtcagagacatcatatagtcagttatatcccctctgatatctcacaggggatataactccaagtattcatgtaggaatggaggctgctcagcttgtaagtgaacatctgggacttaaatttacatctacctagtgccaacgtccattgacaatgaagtaaaacctacctgtcacccatttttccctctgcatgccaccccgacctggtggcttaatattccattttttttcagtcactttcctataatcttctacctccaccagactgttctgtaaaaaggctattctgatgatgccaaaacgtagacctgtgctttatgtatttgaaggaatgggcagggagtattcttctttcccctctcctctacttacatgacttcagtgatcctgatttcaccctcatttttaaaattttcatcttgataagaaatacctaggaaataacaaacaaggagattcaggtaagaattgatgtgaggaagagaactggggagagcattctggaacattccaactacagtgagcagctttactcctttctccaccttcccattacctccaaactctaacacattcctcctactaaaatgtagtatatttaatgtttccttttttttaaacatttgccccagctcctaacacagtgactgtattaattcccatttctgtctcagaaatgcacgtgtgaaactccataggctggcagatatgctccccagacatgtcacctatgacctgtctctagatctgccctctatccaaacggaaagtggaaaaaaatagcttggtcatgcttgttagctgataaggttttagctttggctatattgagaccttgagctgtttttgcttttgttacttaagctgtgggatctggtcaacttggagacaaatagagaaggccttgagaattgaggttctatactgatttgtgggggaataatcacaatgctgttcagaaggagagttgttgcacttgctgtctttttaggaagaatcaaagcttcactgggatttggctagctggcagtcataattttgaaccctatccccattgggccaaacctatcacatgtgtcaaaatgacatggttctttcaggggacttttgggagtgagatccacagcaggcaactctgctaataaaatccagctcaacagtaacattgcattatttagccttcctcagagacatctggcatttgtcttccatttcctttctgttacaactttaccccctggatgctggagatacaagtaacccttcttgctgtgtcttctcttattctcccaataactaagcaacttatttctatttcttaaataaatctcatggttttctgacttctccaaggtcctcttgtcaagtcaaatgaaaactactgatggccccttccaaaaaaaataagtatcattacctagaatgttcctgaattctggttcattagcacaaggtgaagacatgatgtgtcactttttagggccttatcctcttgtttcagtgatgatgctgtagtagacaagaacattttctaaaagagaattatagtcttcagggccaagaaagtagttaggccagcagtcatgaacactatgctacaaacaccagataagaacttgttgccttgccagtggtagaattgttacaaatctatgtgggagggcctttgggatcttctcatctaattgcctcatttttctattaggagattggtacccaggtaggtaaatccatcttcccacagatatgagatgacacagtaaggctataacccagccctcctgatttctcctagctcagtgactgttctgcaataatgtatttagatcagaattcctttctttgtccatcagcatatcctgagtgttttactctatccccaaattacatacccctgtgatttatacttatgtcacatcaaagctatttttaattttctaggtctcttttaaattttggtacgttggtcaagagacctttccttgatctttctcacttgctaccaacgttttcattcctaccctctgtctttattgaactgttaagcccatgttgtcaggaaaattggcacacctttttggccaacgaattaaaggcaaagggataaagtgggttctgctgatcatcatatagctttccatctagtctcaccaggcctggctgatggaggagatttccacctcagcaaagactgtaactacagcaactagtgagttgtattgtccactttatgctagctggtgaggagatccagccaatgtggaagggtttgtaagtacatacatgtagtcccctgcagaatctatgccagaatcccatagtttgggcatgcgtcaaagacatctgatgtggaggccccctcctcacctgctcagggtctgagagactgtgactctgatctaggtgtctatctggcagtcttaatgagggatcctccaggaagcaaaaatagtgcaaagtaaaagggttgatacccctgcctttgacctttattttcaatctaataaacttacctttctcaggaaaagaggtgagagctggtattttggttttggtaactagggtctggggacaaggagctggtcacgtgctctgacagaaaaactaggatttcaacccccagctgggagctggaggggagttctgtcttcctcacttactaagcatgcttgaaaaacattaagctgaatatcagagcttgattgtcctgcagatgccacccattaagacagcaagggctgaggaaggagcctgagcaagtatagaaaagaacttacctaagagatcttaaagcagaacctggaaacactggaagcaggacataaattccttttgcacagcaaagcgatcttgtgttcctggtcagtagaggctcctttactttccttcagctaatgaaccacaaaaagaagatatatatagtattgacttctgaggccagggaattttgttttctttatttttctaaatttgagtagcatatgcttcaaaacatcagatatttactatcctcaaaatgactggaaaacttagaaggataaggcacaaggaatggcctaaataggcttaaataacaaatcccactaatggagtgatggtatataatggaaagacagtgagacattagtcttctttggaaataacgtgtaagaggattttgttaattctcattacttttccttcacttggcactgtaccccacccccgcacttctaactgttacgatagctagaactaggcaaaatgggacaaagtaattcatctgatcatatctttactcattttcagtccttatctcaaaatttgtgagtgatataaaagtcacgatccattagtggctccatacccttcataatgtgatctccattttcctcgcaatcatcaactcatggcacctccctttgatctatcctttctatgccctaactacgaaattagctaaaaaatggtgtagactttcaacacacagcatgtgctctttccttccacataatgaacatccttgctcttacctggtaactcattacttgtcctatacattccacttgacttgtttctccttctgcaaggattttgtcagtgatgttatcatatttttctgatgcatcttctttatgaatactttttggagaatgtctctgttgctggtctcaggcccagggcagttttacttctctcttaggattggttcgtatttatcttatcaacgcttagtagtgacatctaccagcttttcccttttgcaatggttgccagaactctcagaggcaaatttgtcgcacatttgtaatcaagagtatgaattttcccaaatacatttctggctatatttttacaagctgaactgttctttttctcccctttactttaaaatgtgatatcttatattttatggaacctctttctggagcaaggtggccaaggaaggaaggaagagaaagggagggaggcagaggaagaggatgagaggggagggaaagggaagggagcaatgagaagggaaaggaagagaagaaaatccaaattcaaagcctactttcttcatgagtctgtcacctgaaaaaattaatcactttccctctgagctcccccagtacttggaagaagcctctgttatggctgttatagcacttacatctctgcatgtcaattctttgtcttcttggacttttttccctcctatctgactgcaaattctttaaaacaaggacgacttcttcctttttttagtattcccagcttctggctcagttcctagttcaagtaactgctcaatatatgtttattgagtgaacagtagctgaaaagtagctccaggggtttaaaccaatcacacaagttgatttacttaattggagttctgttcaagatttagcctcattctctgaatcagacttgtgaccttcagaactttatgtgtgactagtcacagtcatatttctcattgtacatgtctccaactgactttcagcaaataacctgcagctttatttaatacaaatcagatcatattaaatataattaaaaatctctccatgaaataggataagatcccattggggcatcacaaaacacaattataccttcatggcatatgctcttttttagcaaatctacttgtgagtattaaagtctgacaatcctttctcaaagttagtatcatcttttaaataataccatataccaaataagaattaagaagtcactgtattatttctatcctggattatttctctaagcagaatcatcaacattgatacataacagggatttatttgagttcaatggcaaatcagttacatcagtataacagttaattatattcattctctttaatagatgatgaaattctacaatatgaacttaattaaaagtatcccagtgagcacaggtatgctcaaagtttctttctgcgcaagttgaaacagatgcgaccactggaagatttgctcacttaggtcttccaggtcattgctagggcaattacctaaaatgtcatttgaagcattaaactaaaaatataatcatctgaagaaattattattgattccgattttctctctgttatttggagaagtaataggcacaggaaaaaagaagacagtattgtgagtaggaaaatagattatcatacagtgtttttcaagttgcaagaaaagaagcatttaataatttcttcagacaggaacaaatcatcatttaaataaagggacaaacaaacatgatttaaccttcaacacagatatgtgttacatacacatgcattcacacacataaacacaggcacttgtgggttagagctctctctggttaaattataatgtcaccgtagtcactaatcatgaccagacaccaggacaggacgcggtacagagcaatccacactccagctccccaacttgccagcaggctgctttgcagtgtttcaggaaagaagaagaaaatgagttgacatctgcaagagataatgtctggaaattcacttctacatctagtaaataactgccattctttccaaagatgcagaatttcgttgataagctatctcatcagtgacttaaccatttggaaacatctcccttcaacttactgttccgtgttctcaaaataatagtttcagcaagatcaggggaagctacccctctcctttttttcccccttcccttgctttcagcaccatcaaaatctggagagctgaatagagattacaatttgtgaaggggaaacctaaggttgtatgagagatatgaaccccaccccccaattcccaggggaaagcacctgtcttgaactttgcacaaggatctgccactgagtttcatccttattttctcttcttgctctgtattcctcatagttgaatcatttgtagtgaatattttttctaaggcatctgtatttgttttctattgccattatagtaacttaccacaaacttcacaacttaaaatattccaatttattattttataattctgaaggtcaaaagtctggaatcgaactccctaagctaaaatcaaggtattggcagggctgcatccctttctggaggctccaggggagaattggtttctttgccttttccagcttctagaggctgcctacattccttggctcatggtctcttcctccatcttcaaagctggcaatgtctacttgtgtgtttctcatgctgcatctctctgacactgactctcctgtctgtttttcttacatggacctctacaactatattgagcccacctagataattcaggataatctctttattttagggtcagctgatagcaatctcaattccatctgctatcttaattaccccttgccatctaatttaacatattcagattctggggatgtggatatctttgggggaccattattctacctaccataacatctttctggaagcctcagcttctactcaaacaagctgaccccaagctaggggccacatctcttctttgtactcatgcatttttttcagttgaagttttttcaattggaataagttccagactcattctgtccggtgtgagagtaggtagcagcatttcaagaggctaagatgcttctgtcatcccaagctttgcagagaaagggttgatggggcacagtatgtttgagattttttttttcctagcctaagaaccaaattggagatcttatttatagatattccaccaatatgtctttattttcttcacatatttttggctagtaagtgttggaatcatcatcatttacatatttcccccaatggaaaatcagttactggaaacagagacaacaaacagatggccattaggccagctgtgttgtgaataaaaacagagtagaactaagttacaaagacatggaagacagaatagacttggttctggccgttagccaggttaaattggtatgtatgtggcaactgtgctgcaaaaccaatgaaaccattatgatcagctagaccacaaagagaaagaaaacctatgagaacactgaagttgtccacaaagaagcagattctaatatgaagattgtgcatcctaaaggttatgcaagataacccattggggtgtgaaacaaactgtaagcatttttatacccatatctctatttaaaataagaacttcaactttaccaatatttaaaatacaagccaggcttgttgtcacatgtctgtaatgccagctactcaggaagctgaggcaggaggatgtcttgagcccaggatttcaagaccagcctgggcaacatagcaagaaccctgtctcaaaaaaatacagtttgacactgccacactcattggctttgtacttcagccattcacatatcacacatgtgtattaaagaatttgggctgggcgcagtggctcacacctgtaatcccggaactctgggaggccgaagcgggcagatcacctgaggtcaggagtttcagaccagcctggccaacatggtgaaaccccatgtctactaagaatacaaaaattagccgggcgttgtggtgcatgcctgtagtcccagctacttgggaggctgagggaggagaatggcttgaacccgggaggcagaggttacagtgagccgagatcgtgccagtgcactccagcctgggcaacagagactccgtctcaagaaaaaaagaacttgtttgtgactggggtatctttggttcatatgcagtcaccttaatgtggctaattgcaatactcatgaaattgctaagtagactgattattatattatctagttttaactaaattgacccttacaaaatggacaagtgcttaaaaaatatgcacgtatcttaaagattctataagaaactgcataagaagataaaactaagatgggcccgggtaagcatgaagcaaaaggaagaaacagtattcccccaaccaccagtgtaatctcttcagtcacagaaaaatgcccagtgtgatcaaatcggacacattcaattttgagcacaaaaatatttttgtattttaaatgcatacagtaaaaataaaaatcatgttatattaatacttgtttcatcttccgctctgtttaaatttttatttagtgcatattttaagatgtttgtaatagattagtacaatagtccatgcttgtactttatattctgagggtgtatacacatattttgagggtaggtattcaaatttcttttatggataagggtacacaatcaagatggtttgtagaccattgctctagaggatagagcttttggagggaggcaacaaattccaaaggaaaggtttggcatggaaaaacacttaaaagctcactgagagaagggtgtatcagggaactctagtgtaggtcataggacttgctacactaagttgcaaatttgtccaaatctgacattgccaggaagctaagtcttgcactaatctttgtgtagtacttttatcctataatagggtccatgacatattagataaagaaaagaaaataaaccataagggtctcagtgagatcttcaaaattttacacttctactttgtttttaatgcttagtaaaagaactgctgaaaaagtcattaaaaaatgagtattttgtctttaaccaagagccgggaagtatctcagaaacatatttcaacattaaaatatcaaataatcaatttttataagaagtgcatttaattagcaacttggctatagctagcacacagtgagttaatctaataatcagtgactctctggacagagtcatcttaaattcagctattcttttatcgatttaagaaatgtaataatatgcattttatagcaaatggctagaaaatttcagctacagaatacttcattctatgaagcctgattattttatggcttagaagatgttcataacttctgttccaacatgatacagaagcatccttcagaatgttatctttaagatcacagaagttaagagatttaaatttcaaagtgaatattatccattttctgttcttttttagcctacttctaggcaagccctctgatgccctcatcgtttgtttaaagtttctctttcttccaggctactttgcgaatcaattccagatcacagaggagagaaaaccttattccttttttccaccccaagctcaccttcctagacaagatttttatctacattaaatacattcgctaacccaggatagtgacctacccatagcagtggcttctgtggagctcagcagaacatagagaagtcccacaatgcttgattaaagccatcaggaaagcctgaggtaattctaaaagatcccactctgtggtacaaaatggccctagaagccaatcttctgactacttgtcattttatttcatttcatttcattttttcttttcttttcttttttttttttttttttgattcagggtctcactctgtcaggctggagtgtatggtgtgatctcggctcactgcagcctcgatttcctgggcacaagcaatcttcccacctcagcctactgagtagctgggctacaggcgagtgccaccagctaattttttgtattttttgtagaaatggggtttcactgtgttgcccaggctggtctcgaactcctgggcttaagtgatctgcctgcttcggcctcccgaggtgctgagattacaagtgtgagccaccacctggccttgtcattttgttaccgttaacactttcctctaggtctggttcccaatgcgcagaatccggggaatttgaacagggctctcttggagagttgtttcattctatgtgctgggataaaaacaaattatttttcctgctaggaatgcactaaagatccctccactgtatcttccaggaggttcatattagtatttgctttagggataatgttttggattgcaccacagagcaaagtttttggtcagacaatctaatgggactaataacagccgacctgaacattgacaattcttgcacattatcccattccatcctcacagatcagagaaacccaattaggtaacatttccccacttcatagaccagggaaggaaatttctgagaggttaattgatgtgctgaaaggcacataaagtgcccggctcagtcccacgtctggctctagattcctttttagttcttctgtattatgctgtctcttctaaatggattattaggttggtaatgttattcttagtcattctgcccaaataatgaataacagattatacatttaagatgttaaaatgtatcataattttattataactgaaaatgttcagaatttttttaaataataattttggggaaaagaaaacttccttatacattgtttcctcagtatttttttcattaggtattttttccatttggctgtggcaatccttgagattgattctcactgtcagggtcataactctctctctttcacccagcggtaaccatggaaacatatgtataacacgtcctgcttcttttaatatgattattcatgagttgccataaaaatataaagtgtatttgtttgcatatttaattgttaaaataacacaagtatttgcttttaaaatacctactcatagctctgtggtcatgtatacataaagtaccaaccattcttaaatcctaggattaagaagtgacatgttgcaaatttagagtaccttgctcttcaccagttgtatagcaaaagagttttagtcagtttagaagtaccatgggtccaccgcgtggtggctcgcacgtgtaatcccagcactttgggaggctgaggcaggtggattgcctgaggtcaggagtttgagagcagcctggtcaacacagtgaaaccctatctctactaaaaatacaaaaaattagctgggcatggtggtaggcgcctgtaatcccagctactagggaggctgaggcaggagaatcgcttgaacctgggaggtggaggttgcagcaagccgagatcgcgccattacactccaggttgcagtgagccaagattgcaccattgcactccagcctaggcaacaagagtgaaactccatctcaaaacaacaaaaaaacaaaaaaacagaaaaaaaaaaaaaaaaaaagaagcagcagcagcagcagcagtaccattggtcgaattagggttcctgtcccatttttctgcatacatttaaagtctaatgtgatatagtaagtactttctcctttgaagatcagctataatctcagaacttaatatttcacttgtatagaagttactcttaaatcagattctatgacccagacagccatccagaattttagttcgtcatctctagcttcctaataaaaatatccaagtggatgtcccactaccccttccaattcaatttgcctaaaaccaaacttgttatctttccttcagggttcaagtcctttcagaaatttcttaattcaatctccaatcccatcattctcttagttactcaggcttaaacttttgttatcctacggcattttctttctctcttctttcacgtcctatatcctataaattattcttagcttctactagcctttctatttccactgccacacttgttacattgtgctgagactaccctacagtgctttaacaagtcttctcccccagctctcatctctttgtatctgccttccagtctactccaaggtcgaactgtctaactcaacattttgcatatgaccctcaccccctcacgacaaccatttcttctaaattaaattgatgtataacaccattcaaaagttatttctttcagcttcaaaacaatcactccagtatatacattacttgccaacatgatgtgaggtgaaccacatttcttgcccacacgctgttctcatttctgttctagttcctcacttatgacttgtaaattgaaagcacctagatttctgttgttattctggatgagtaatggcaggacaaccctaaatcccaagtatttctgtggctcttttaaggaaaagaaatatacaaaaatagtctaaaggaagaaaaatataaatattctaaacattagtcttatatctgtgttacattgccattatatcagttttgcttgaaataagactgtggagattagatattagttttaatttatgacatttggcaattgtaaacaatttgtgttactttattcttttagaatctgtgtagttttccaaaattaaaattaaaattccatttctagccatagaggagtcttcttagttctatttgagtcaacaatcatttttaaagttttaatttgaaaattaaggacagatccaactaggattgtgagtccagcagacatactgtgtgagcacacagctgtggcatatctgtggaacggataagggtggcatattttggcacttgtggaacttattcccatcattttaaacaatgcttggtaggtttatatcaacagatttattttcccttcagctattacgagagtaaagcagagacctaaggtctggcatatgaatcttacaaatgagggatttttaactaggagcgactctgaaagcttcttacattcttgggacagtctgcagtcatagattgaatgagaaaagcctcatattttggctgggtgcggtggctcacacctgtaatcccagcactttgggaggtcgaggtgggcggatcatctcaggtcaggagttctagaccatcctggccaacgtggcgaaatctcgtctctactaaaaatacaaaaattagccgggcatggtggtatgtgcctgtaagtaatcccagctacttgggaggctgaggcaggagaatcgcctgaacctgggagatgaaggttgcagtaggctgagatcactccactgcactccagcctgggcaatagagcgagactccgtcaaaaaaaaaaaagaaaaaaaaaaaaaaaaaaaagaaaagccccatgtcttttcattgaccatatacgatctcttaaccagcacagcattgatgcatttcagccatctcacaaaacttcccttttatcattctgaaatgattttatctttcccaagagactgatagacaaagcagctttgtatactcacgtcctggttattgtgcattattaggaaacagataggaaagctaccctcatacagaggctatgtaaatattatttggggaagaggaaaaacacatatgggtgctaagaagataagacagtgcctctgaccgttctatttgatgtttcttaaacctgcattgttatgaaaactcaggtaaatgaatttgtaatgactactgaaaatgaaacaggagtatacttgaataagtattgacatttttttttcaggtcatttactttaagactcacaaagaacatattagctaatagaattcatggccaaaccatgatgtaaatggagctaaggtcagaattagattccttagggagctgaagaaaaaacacggctatgaccctaaaaccaatctgctgactgttttctgctgactcttttctgatgcaaagtaaatggtgggaaaaaaaaaactgatactaaaaacaaacaaataaacaaaaaaacctctaactatccaaccacctgtgcaatacaatagctttctataaaataaaacagaatggaaaaaaaatctcaaaatcatgagttgaaccaatgaaacatacgggttggttcagcattgcaaccagatgtcatcttaataaaaaccaacactattagctctttgatgattaataatagtaaataccattatcacactcaaatatgactctttaggctgggttactaatatatacaatcaacctgcatttttcccgtctttccggatttgacaggaagagtggctgtggcatggaggaagattaaaagtctaagagaacctcggatttagattctagttgcggccctgccctttcttagttgtgtgaccttgagaaaatcagctaacctctctgaatcctatcccttcacttgaaagtgtgttaaaatggcacttatacatgataattgtataaatacgtttatatatggcatatataagtaatacatatgtaatatgacagtattgaagttaatataaactaatatgatataatgtgtttatatactatttacaaattatatattaatataatgtatttatattaacataaatacatgtatattagtttaaattatatatgaaaatcttataattaaaatttttacatataattattaatatatcataaatttctatattatatataataaatttatatataaatcatatctatacacacaatgctttgtcatgtggggtcataaaagagtactgcaatcattattatgtcttcggttaactttacaatgaaaagcttcttaatcaatattaaactacgggcaaatataatgctgctgccttctaatgtaatttactttaggaaaagcaattgatgagataaaaggtctttctcttttttcatttttatttttttgagacagagcctcgctctgttgccaggctggagtgcagtggcacgatctcagctcactgcaacctccagttctctagttcaagcgattctcctcctcagcctcccgagtagctgggattacaggcacacaccaccatgcccagctaacttttgtatttttagtacagacggggtttcaccatgttggccagaatggtctcaatctcctgacctcgtgatctgtctgccttggcctcccaaagtgctaggattacaggcgtgagccaccgcacccggccaaggtctttctctttttaactttgtttgcaatacctagcttgccttcatgctgttatattaggttagcattaattttccattattggagcagattgcctacaagcacacacatacaaatagtacactgaggaggaaggagccagtgctgaagttctttttctgaaacgtaatagagcttttctcattactgcaaatacatgaatgaatgaacaacattgcaagcacagacgttgcatacattctctcatcaagcagcgccatcactgccttagtactttttgttgttgttcagcattattgatttttccaacaatcgagtttgtttgcaataaactgaactggagcataaccttcactaattagaaaaaatgtatgggtattagcttaaggaagcaataacacttcttgtacgttttctatcgaaactcagggtgatgctttgtaggagtgctattgtttcttttcccccttgtgacaatgttgttaagtatgatgcaaaaaagtccaaagaccttttaaataatttgcatccattctagaaggaagaagaactacaaaggccaggtgtgaatggatatgaaaatagcaacttagaatagaaatatctgccattactctctctgcatacctctaagcctttgtccctatttacaattgtttttatattctggtccactttgaaagtgaacaccttaaggatctttgttttaactataaaatttagaaaatattccttgattcatatttatatttgctgggtaattatcatttataaaatcatagttgaactaagaagctagaaaaaactacatgtgtgattaactgtttagtttttcaccatttctggtcaggctgtttgaattggccaatgcagatttcttcatcccagcaaagcttaatcatagaagtaatttcaattatataataaataaaagctgctttgcctcagcatattcagtgattaaaaatgagtcgttttttaaaattttcaaatctgacagtatttcttgaaagaaataatttgtgatggaaataaactgaaaatgaggaatacaatggtcattgaggtgcaaaccaatgcaacagaataaagttaacatgaaatttgaaattattgcccagaaatcaaagtaactataaaaatatagctgttattagggaaatctctagtaggaaaagaaagccagaaattatcacattagcattaccatgggatgtcattctagttcttaaatagaactaaagacgagagcatcgtgactctaccattcatatgaaggagactaaatagacaatgatcttgaatccatttccttttaaaaatcttaacagcatagggtaagtatttggtgatggattcttggctgcagaaaattcctcatgataaacagggtgctatcattaaataacacacatgctaaatgctgggaatacattaattcctccaagtccaattccctgtaagtcatcttattctctaaaaatcattgtcataaagggaattctgtgtgtgacatctgagagtaagcatgtttagaagtgtctcaagagtacctgacagtaataaaatcaggaaggtaagacaagaattatccagtctttgcagggtcaaaaatgacccttctctttattccttaagttttttgtgtttttttttttttttttttttttttttttggtgagatacagtttagctcttcttgcccaggctggagtgcaatggtgcggtcttggctcactgcaacctccacctcctgggttcaagcaattcttcggtcccagcctctcaagtagctgggattataggcgtccgccaacatgcccggctcatttttgtatttttagtagagatggggtttcaccatgttagccaggctggtctcaaactcctgaccgcaggtgatccacccacctcggcctcccaaagtactaggattacgggcatgagccaacatgcccagccctattctttaatttttaagtagctttggccttcactagcattactacagtcctatatgtaaaagtatactgctgatgaggaaaatatacctcatttaaaatgtgtgctttaaagtcgagtctctgctatctaccataccaatgtaggttttggtcactatcaagttattttcgttctcagcaagtaaaactgccatgttcttcatgatttttttctatgcatacacagtcattgctaagataaacattatttttagacatcaaaattcctagcttattattttacatcatattagtgcaattgtcaagagacaattttatatttcttaattcactttttctctttgtaatctgagttccccaaataagagaaatattaataagggtggcatattttggcacttgtggaattaactagcaatatgtaaattcctaaatagcatactgttaaaatgcttctattcttcaaactctaataatttgctaagaaattatgataataaattttaagaatttttggctaagtgcagaaaaatctgttgaattattaatacattagcaaaatgtatcatttagggaaataattttattgtaaggaaagaacttagaaatttgataataagcataatttaatgaataattttctgaatgagtcatttctttgcaataaaaagaatttttctctctacatatgtgtggagcaagtttctgtaaaggaatccaaaacttgtaaggaagggaagccaaagaattaccaaaaaatattcctgggtgttttgaggtttcataagatatttgataacatattgaatgactctctttgtgaaacatttagtagcagacagtgcaggaaaaagctcattcttttttttttttcttcgcgacaaattcttactctgtcacccagactggagtgcagtggcgcgatctcagctcactgcaacctctgactcctgggttcaagtgattctcatgcctcagcctcccaagtagcagggattacaggcatgtgccaccatgcctggctaatttttgtatttttagtagagacagggttttgccctgttggccaggctggtcttgaactactggcctcaagtgatccacccgtcttggccttccaaagtgctggaattacaggcgtgatccgctgcacccagctgaaagctcattctttactaatcatgaaaccctatattaaaaaaaacaaaacaataaactattaggctggtcttttccagtgatatagccaaagcaccatgccagcaagtgaaacataataggccctcaataaataattgttgaaatagccatatgatcagacttcacacacaaaggctgaactgagttgaggtaattcaggatagaacccactggataatcaagcacataatattggctttaattatgtagctgtttcagaattgagaggtgatgaagggactcaaacagcttgatgctctggctactgggctgtttggatggctatgtgctctttgctcttactccattgtgaatttctgaagccaggacagccttaattagatgtgagtctgatatgataaatatgttgctatggtgaatatgaatgtttcatacaacaatatttcatgccaattaacagtaaattccaaatactttgccaataaaattgaaaataccattattccattggcctgtccatgatggcataaataatgcatatttgtttatttatcaagagggctcttattgaacaccctgagctttctaacagttatctcccttgtgcagtgtgccagctcattaggaagactaaagtcacagtggagtcatcctgaaatgacttcaacacaaattccatgtaaaaagatttttggagagccatctgtcccggggtctaggttatcttttggaaattggaactaaatggatgaaaagtatagaaatgctttggtcttccaaatactttcttaatcacctctaattgtaaaaagaggaaaaagtggctttaagaaaaaatagcaaattaaattaattcataagctattttgtatgatacaggagacagacatttataaaagtaattgtgcttagttatcttattgcaagccttcatctccacatttgacttcactggcaaatgcggcaacttacaaaacaaatcaggccatttcaacgctagtactacagagcttgtttttctcccccaatcttaaagagacttcatggatattttaatgttagattttacaatttaacatattaagatatgattactaaagactaattcttgtctctgctacctccatgatttcattactgtcatgtgccgttgggacgcttataaagccagaaacaactgtagcagaatgtgtagattacatgccattagtttcactgttcataatgccgagcatattccagagtatgtgctgaatgcctccaaccttcatgaagatatcctttttccttttttccataaaaagacatcattgatggcaactagtataatggacagatcattcaaaaagcacatttgatcatcaaacattttccaggtaccaaaaactttctggaaacacacaatagaatttaaacctagtaagaaggctggatgtgaacatattgaactctaagccaataaaatgtacaataatagaggtatgcaattagtatatggagacacagttgatgatgccattaatttttctttgggaggtaataattataacatctaatcttaactgagtaattactgtgggtcacattctgctttaagtgctttaaatgtactaacagagtgagagggaatggatattatttccatgtttttagactctaagatataatgcatcttatccaaagccatggggctagttggcagtggagctaacattttaactcgggaaatatgggtccaaaacctaggtttttggcccccaggccatactgcctttctgttttagagtcatctaagaaaagtctggagacaaattgatatttttgttaaaatctaaaatatgaagatgacttcatcatttaaagaaagagtaggaagagaatttaaacaaaggacatatagtgagcaaaattaggaagaaatatgggtccaaaacctaggtttttggcccccaggccatactgcctttctgttttagagtcatctaaaaaaaagtcatctaagaaaagtctggagacagattgatatttttgttaaaatctaaaatatgaagatgacttcatcatttaaagaaagaatagaaagagaatttaaacaaaggacatatagtgagcaaaatgaggaagaaatgaaagggagaataaattgatgggaagttgcccaaagtttgagttgctaaattggagggcatgcaggaagcagcatgggaatgaaattgtaaagggagatggagcccagactaggagtcaccttgtaggccatgaaataggatttgggcctgttctgtgggatcccttaggggatattgttatactcactcttaacattatactgactccctagccaggtcaaagtacaatttaagctgccaatgaaatatattggctttaaatttttgtcaccatttttaaagtgtagtgtggaactgaaacattatataaacattgtatagacaaaagaaaccatctattctaaatattcttaagctgtttgaataatgattggtctaaatgtattcctttcacataaattatataaactccctttgaaatgatgtatgagttaaataagcaatttttatgttaaaaagttcagtaattttaaaaatgaaaatgctcttactgaagcctccaaatcatgcatactatatacaatcttttatgttgtaaatgtccatgataaaagaaaacaaacaaaacaagacatcagcaccaccaccaataaaatttcaatcagaagggatcacttggtttgaaactttatgcagctctcagatagccagactttctttgtcaaaaacattcaatacaatgtttaggaagtgtcgtgtttaacagaaaacatcatgtgctaatattaatttggaaaattctatgtggtggctgacaccctacagtgttccagtctcttggaagctattcgggaatagtgagtgttccttctaactgttttatgtgggggtatgtggaatcttctaatctccaaagccactaggcttctatcctgactcttatttcctgatatatggaccctcttcttaactctggagtgttggactttctcttttctgcccttcactggtggcttggtttagttttctggtaactgcatttcttcctgagcacatccagaatcttctcagaggaggcaatcattccattctttccttgtgacacctcaattctccatctccttacccaaagagcctcctttatgtgtcactttccctttgaaattatcttttctttcttagaaaacttttcgtttctattttaagaaaagctgggtaacgtaagaacatgaaacattaagaggcagatggtaaattgattagacataagatgcttcgtatttgtatcctctgtcctgttttccactttttcttcagaaagtagtccgtgactttgtattcatagctgtttttcactttacatatcaagaaccaatgtttgggaaacaaataattgtgagtaagtggttatattgagttgcatatcagaagatatttaattttataggttaaatttataatatgaattgctatggtataattttgagaaaaaaaatcatttttagtcattacaaatatttattaatggccacactaggaaacaaagattatgagcctcatataggatacattttttgaacttgcaaaggaatacaccatatttcattaggtcagtaggtctttccctccttaggtattgatacgcctacaagtgtaatgacgtggcatttataatttggtaaaaataattaaagttcatttttgtgaacaacttagtttttaaccaattagaatctacttagatacattctataattacatcaccctaagatatttacaatctgatcaatgctatttttcatgaggaagagtgatagaattagagccacagtctagctgatgtaattatagccatggaacgaaacatatgtgcctgccatttatctcaggtatctcattgaaaaaaaggatgagaaaagctgatccagagtaggtcactaagcatcatccataaattgagaattggttctcaaacaataactttgaatcagcagaaatccagtgtttgctaaaagctatacatgaagagttaaagtagttgatcccctcaactctagtctctgcttatttttatattaaaagtcaaatgcttgctttgttctgaaattaatatacatatacacacatatatacatatatatatacacatatgaaatataacatgaatatgtggattatatcagagcaagtcatcatctaaaactagattctagctaatatttcagcaaatatgggctaaaaacctatgtggccacaaaatattgatacagctgtgaataaattaggtataattccttctaaaattttcagtctacagtggagacagccattaaataaattatcatgtactaaccaaaataaataactgcttatcattactgaatttctgatgttcttgcaaaaacaatttgaaaaactatatgtataaatttactactgaatatggtagtcatcctttaaaagacaatttaatggcttcttggccttttggctaagatcaagtatagtatctgttcttatccatttaaaagacaatctaccataatacctgaggaagaacatatattttataataacataaatataatacgtgttctcaaataaaaattaagccttctaacaagtgattttacttttaggcacgtaacttcaaaaatatggaaaaatggacgctgggtgtggtggcccaaacctataatcccagtgttttgggaggccgaggtgggaagatcacttgaggccaggagtttgagaccagcctgggtaacatagtgagaccccatctctaccaaattattttttaattagctgggtgtggtggttcacacctgtagtcctatctacctgggaggctaaggcaggtggatcacttgaacccaggaatttcaggttgtagtgagctgtgatcacacagctgtgctccagcctggacaacagagtgagaccttgtctctcaaaaaaacatgaaaaaatgtaactacctatatctatatatcatatatatgtgtgtgtatatatatacacacacatatatatatgataatatgtaactacctatatctatctattttatatatatatatgtatatatatgtgtgtatgtatatatatatatatatatatatacacacatatatatattaggtcccacagatgtacaaatttttaatgtacttttattgtaaataaacactgctggatttatatatcaaaaatattgctgattaagacttgatggcccgggcgcaggggctcacacctgtaatcccagcactttgggaggccgaggcaggtgggtcacaaggtcaggagatcgagaacatcctggccaacatggtgaaaccctgtctctactaaaaatacaaaaattagtcaggcgttgcggcatgcgcctgtagtcccagctactcaggaggctgaggcaggagaatcgcttgaacccaggaggcggaggttgcagtgagccgagattgcgccactgcactccagcctgggcgacaaatcgagactttgtctcaaaaaaaaaaaaaaaaaaagacttgatagacattagaaagttaactgagggaagtcatcaaatccacttccttaaataggtaagattctccttcgatggtgctaattcctttgagaatacttgaatgaaaggagatgagcgttcatgtattatttgaatactgaatcaatgctttcctgagtaaccttggtgatatggtccttccacatctgagagtttattttgcatccccagatattctaccttcattgcaatttttcctccaattggtttagaaatggtacagaggaaagttagtaaaagtaatcactctaaaagtgagtcatttattcttttatcctatgtaagtaaaagaactgaaaatcaagcagttagctttaccctgtggtctcaaacatatgagttaaaagacataataaaaactatcaatgtgtccaatatatttgtccttagcatcattaatctattccttgtaaggttggagtttataaaatgagactccataaagagagagatacctagtctaaatcaaagtgtgtgcgttatgacatagtagaatatattgataagttaactgaaatcaggtaattgcgggtagattggcttaacatgtccaaaacattctgtgtaagttaaatgactggtaagtaaaatggtgggactcatgaaagttaatttaattatatcagtcaaaaatacataaaataatttcaatactgttacaacctcactctagtaggtgtttctcagaggcacttgcttcattgtttatttgtcatcattcctaataaacatatatttgagttcatgtcatctaaaaataaatggcctaccctacagagacatggaaaactgatgtaggcatacactcacccaacatttaatgacctgaatccatctcaatgacttccttttctattcaaataaccagtttggaatttgatttactaaaattaacttttgtggtattgtttcaacaaaggacagccttttgtgtgacaacctataatatttagctactaaaagacctaccatatttctctcccactgagaattatttgttatctaatatcacttatagacttcatgtaaatcaaataattatttctggctctgcatggtgtaaggatgattaaaaacttgtcaagctatcagaagaataaggccacttcccagcatggaatgacattatttattctaggtccaatgattggtaccagaactgacccttaataataatatttatgacatgggggtgggaggggagaaaccatttagaatgattagtcttatcacaatcctaaggcattagaattttcaaaagtgctgaaataattgtgcaactttaaggaaatgtataagaaggtagctaaattatcactgaagttagtgaacactatgcagtgctaatcatgtatggcttctcaaaagcatttaacactcttgacaactgtcctcttgagatgctgtacctacttccctctctgttcttcaactttttctctattcatttgctgtctctttggctgtttctctgtattttgttcctccattacatatttgaatcctgtgatttgtcatgcattatctttgcttttcattttatgtgctgttctggaaaattctactccttcaagtgcgtttactgcttttcatatattctttaggcaagatctttttcttgaccttcaggcccatatcagcacaccaggagaaatctcccactgataactcagattcatcctggataaattgatctcattatctgtcattcaaaactggcttttcataatatatggctccaaaattcttatagtcatgtagcaaaattcctgggagttattctccctcacagtcccatccattaaaatctgataagtgaactgaaatgctactcaaaactctattctgggtcttctttccccactaccctgactcatgttcccattacctgtccattatcaccattccaaaagactctctgcctgaattcttgcacatctataatccagcttcccaagtgtgtttttttaatacacagaaacgattagccgcaacagcctttaacaatacaagactgcctgaagtccaaacatactaacttgacataagtatcctttgtggtcatatgttgagcctcctttccagcctcctttagcttggtcacctttgtgctctaagtttcagctatactatgctaccaaggcatagcaggatgtttcacacctatatgcatgagcatgatgtgtatgtgcatggacacatatgttttacacaattctcactgcttataaaacacactgcatcagctgtctattgttacgtaacaaattagcacacatttaatggcttaaaacaatacacatttattatttcacaatttctgtaggttagaaacctgggcatggccatgctgggtcctttgcttcacagtgtctcatagatggcaataaaggtgtcagtcaggactacagtctcatctgagggctcaaccggggaaggatctgcttctatattcactcagtggttgttggcagaatttagtttctcaaggccttaattcctaactaggtgttggccagaggcctttttcagttccttactacaagggcttctctataggcagctgcctcataagtatggcagctgcttcaccaaagccaacagtgaagagagtcttttagcaagatgaagttcacaatcttacataacctaatcactacagtgatattccatcatctttgacattttctattttgtaggcaactaggtttagcccactctgaacaagttggaattacacaaagatgcaactattaggaggctgggattatgaggagccatttcagaatcgaccacacccaccaaccccaccttcctttacccccatcaacctgacaacacctgctcaaattattgaagactcatgtgacttaccaagacctcagtttttcaatatttcccaacaaacccaccatgaagttggttactcctttcttcatactcccagtacacctccaatattatttttcaattattgtttacatagttttctctcccgtcaatactttgagaacaaaaaatgtagtgtgttattttctactctctggtaagatcagtccaaagaaagtgctcattaaatgttgaataataattgtttaaagtaaataaaaccacagatattaaatacataaaattatctggaaacaggtaattaccccagggataattgacagctaacgatgtgcttaacatctgaatgtatcatttactttagttagagtacacatggtaatcttttgtgagtgacatcacaaagtgacagattcggatgtctctattatttttaaattctttcaaatgagaaacaactataaaatgaaatgcgatgtggataatatagtatagtggttaagatcactggctttagcatcagtcaatgggatcaaatcccacttctaccacttattaactgtatggttttggacaagttactttaacctctctgttcctttctttactggtctgtgaaatggggtctgaaattgcacctacctcatagggctgttataaagattaaatacaattatttatggaaagcagttaataaagacctagtgtgtatttgactctcagtaaatgtcaatcattattatctcctagtatactgaaatagaaagatgtccataatatgaaacttggagagatgtatgtaagttgttaattatctttaatatatacatagatatatacagttaattcatctatatgtttgtatatgggaaaattgggaagtatacacagatttttaataatgattatttccaggaattagggaagaggtgagggtggataactttatttttttattttgcagattattgtattatttgaattattctaaataagcatatatcacctttctcttttttttgagacggagtttcactcttgtctcccatactggggtgcagtggtactatcttggctcactggaacctctgcctcccaggttcaagcgattctcctgtctcagcctcccgagtagctgggattacaggcgcccaccaccatgccagacttatttttgtagttttaatagagacggggtttcaccatgttggccaggctggtctcgaactcccgacctcaggtgatccacccatctcggcctcccaaagtgccgggattacaggcatgagccaccatgcccggtcgcatatatcacttttataatctgttatggattggatatattcgtccaaaaagatatgttgaaatcctaaccccagaatgttactttctttggaaataaggacattagagacataattagttaaggtgaggttatgctggtgtagggtgggccctaattcagtatgattagtgtccttataagaagagacatctagacacataggagagaacaccactgggtaatgaagccagtgattgagtgctgcagctgcaagccaaggaatgccaaggattgctgacagagcaccagaagctaagaagaggcaaggaaggattcccctacatgtttcaaagggatcgtggttccgccaacaccttgatttggactcctaacctccagaactatgagccaatacatgtctgttgttttaagccacttagtttgtggttctttgctactgcaggcccagaaaactaacagatagccaaaataaattaattaatatttttaagtatatacaaaaaagaagagaaaagacaggcagttgcatagctcataaaattataatctcttgaagttgaagcttcaggttcattttgactcttacctctccggccatgccaatagaattattagtttttgacatcccagccaaatatttgacaagcagttcataaactaatgggaagtgctaagaaatataatatggagctatttctttctattctgttcctccatgaaatttcttctatccaatttccaatcatgcaaatcgtatcaagaaggcaagtgatccaagggttaagcaacatttgattggctgctgtgactgcatgtatctaaagagaaatagaaagcaatttgactacggtatgtgactcaagtgatatgtgttttagataagtaattagaaacaaaacaaaaagtcaattagtttctagcctgtccttcaactgtttaaaatattatagcaataaaactaatggagagttttttcctaactacatcaaagttattaaaatgtagagtcaattagaaaaaaaatataagaatgtacattcataattgttgaatactaacaactcatatcaaatggacaaactgtttgacaccaatatatgtgggaaaggtcagggcttctaaagaaatgtttctttaatgatgaaactttccaattttaattttttttaattagcatcttatagacggaggaagaagagggtcaaaaacaaagaactttttcttgtcttaatatgtatagccatggaagatggcagaagggagtgaaaaaattcaatcaatcatttttataaataaaacaaatggagaaagcagtggaaccagtaaccccaataatggatcctatattattatttattttatttgcctatctctttcacagatatctagctattcatcaagtagacattccctccaaggcacaaagaaacactgaagttttaatctaccattgtttaattctttcttctggcagaaatacttgtgttcataagaaactttccaaattaattaaacttgtttaaggttgatactggccagagactttcctgtcttccaatttaagagattttgatgaacatatgagaattacattacaaaatatggcaagacggggaaagaaaatagaagaggtgaaagaaaggagagggaatgaaaggaggaagaaagaagaaagaaaactgaaaatggaaatacaggccagacgcagtggctcacgcctgtaatcccagcactttgggaagctgaggcaggtggatcacctgcggtcaggaatttgagaccagcctgaccaacatggtgaaacccccgtctctactaaaaaattacaaaaattatgcgagtatggtggtatgtgcccataatccgagctacttgggaggctgaggcaggagaattgcttgagccctggaggcggaggttgcagtgagccgagatcacgccattgcactccagcctgtgcaacaagagcaaaactcttctcaaaaaaaaaaaaataataataataatacaaattttctctcattcatttcacaaatgtcaagtattggccattattcctaatgtaaaaaacaaaacaaaacaaaaaaacaaaacaaacaaacaaaaaatacccaccgtgtttcacattgttctgaagtagttactgttggttattattgagagtgcaaaccacccatgcttcctcttgggctaatgcagaggttaaacagcctgagaattacctgcaccatggaaatgtattctggggttaataagaacaaagtgtccatctttgagttattttaacaactaaaccctagagaccagagataaactaaaggagaataaagaaatataattacattggacagtaatgtcatgaagagttaattaattaggattcaatgagtcataacttattttgaagatgtggcattttagaaaaccacctagcttcattcatattaccctcagacattaaaggtgtaattgttgtcattagcattttaattggtcctgtaatttaatggttatacacgtggttgttgtaaggtcttttaagctgttgggattttaatatttgacatgtagcttgaaaaaataattatgacatttcccagatctgaggttggcctttgcagttaatgacaacactgcgttttcaaaatggttattattgatagtacaaatactcaaatggcctacagagctaccttcatctgtaccatagttcttttttttggagatcactgggattatctaatcagaccaacactgccaccatatttaagcagtatgtaatgtatggtagatatattgcaaaatgccaaaagaaaagcacttgtagtagtttctacttggaaaacagtattgttactaaaagttatggcagaaataatattttattaactgtaggccttgattgtcttgattgcaaatgctaggtactatattatgcacacagcttgaaatgtatgtggcacaatgaataaaagcttactttcctaaaatataaaatgattgaggaatttgatgatcacatttaaatattttcaaaaagggttattttctacccagcagtagaataattgatagataattacaaaagaggctatgccaaaattattgctaggccctttatattgagacaatggtctttatatagtgtttgatgagaaatctatcatttcccttggggtaatggccagttatttaccaccgtaacaacttaaatgactctgtttctagacttctagttaggggcacttcttaaatcttgaaaatggggcaaagcataaatttctaagatttacttggttgtcttcacccttagtacatggggtgagtttcagcttacaaacctggcctctcctctgaaactagcaaggaagaaccaagtgtcacaatatagcaggagctcttaatccgtctgcacaatcattgcgagatggggagtggataggcttcccagtcagtgcctctgatttgattggtccagatctggggtgtggacaatttcttataaagctctcaaggtgattctaatatgcatccagggctgagaaccacttcattagtgattattagatcggttctcaaaatacagcctaacattgatggactctgtcgatggcaatatcctggttgtgatatcgtagtatggttttgcaagaggttaccaccagaaacaattgggtaaagggtacgtggaatagactctgtctgtattatctcctagaactgcatgcaattctacagttatttcaaaataaaaaagtttaacttatttgttaatagtctgccagtgaactccattaaacttacttgtgactcttaaaagatgcagacttttgggccccatcacaggtctagcaaatcggaatacctgtgggtatgtcctggaatctacatttttaaacaagctcaccaggtgattttgctgaaacactgatttagctacttacatgtttaggttttgagtaatactgggcacctggacagtcctaggtaagtgagaattaggcaaactggcacactaagttccctgccctattcagtattctgctattcctgctacacttgtcttaaaaaaataggatttcatataccaaggtgttatgatgatactaaggcacactaatgcataaaaataatatataatgaattattcagtcattcaacaatttttttattgagtacctattatgtgccaggtacagttctaagcattgcttttaagaatgagtataagaataacatttgtaagcctatcacctcaggcattctgatagtacgtggatttcttatttaagcttcacaaccaccctgatgtaggttcttttattctcccctctttgcacaagaaaacactgaaacaagctgttttatgtacattgctaaggatctagaagtaaaaactttgaatctgaaatcagatttcgactgtttctttatggtaaaatatacataacataaagtttacctttttaactatttgaagtgtacagttcagtgacattaaataccttcacacactgtgcaaccatcaccaccatcaatctctaaaacttctccatctttccaaacagaaatccagtacctattatacaatatcaggggctgtttttattatacagtatatgacacccccccaccaaagaaacctttaattgtagaactttatacaaaaggtaaagaaaacaatttgggagaaaagcctctcgccagcatttcttcaatcacacaacatattatagaaaagctgctgtgtgtaagatcagccttgatctggctgtatttttattgaatctaaaaaaaagtaattatcagaactattgttataacttaacccatttgtgctgcaattgcttctcatttgtgaaatagacactaataaggcatactaatggaatctttagtgtgagtatttattaaatcactaatgtatgtgaaacacttagaacattgcctggcatttcctcagtccacccacccaatcccacccacacacagtcaaaagttagttcttatttccccgattgtcaattttgtatatatcacttgatgcacatcattttcccacatctttgtcactgattgttagttttatctagttcagtagcaagcacaatatctaacaacctgaatttatttttattgtaatcatttcaaagaaattagagtcaaatgtcctcaactgtatgtctccagtaatttcacttagaaagtttttcaggcactgaattcgttcttgagaatagagtagcattcccctgtctgtaatatttgagcagaaaggacattgcttccatgaagccttgtttctgttcttcttctgtttgttagaaaatactctgttgatggcaaattcgtgagcaatctaaatatataattaattagaagaacaaattgaaattgaccaaatctctcagagctttgaacaaaaggactcttcaaatggtcaaaacaattacttagaatttaagcgttcattgaaatgcgagacagtgtgcggtagagatacaaaagagaaaccaggctcccatgatattgtaaatgctaaccctgctccttaagcaaacaaaagtctctttctattgtcagtagctgtcttctaggacaaatagtttggtattttataaaagggagaaaaacttatcaaaaacattccatgaaatgtacctcttttgaaaaattactccttgaatttgagttaaagaattctttagaagccaaactgctgagatgatttatctgcacaaaagaaaactactgttcaagaagcatatttgaagaatatgtcattgcaaatcaaagattcttttaaaaataagtctcaaaaggaagagagggagagagggagaaagagaaagagagagaaatatataattaaagtcataggtaatttaagtttggaaatgaacattcattcactactttgttatattgtcatatggtggtaaacaaaacaaagcaataattttgtctgattttcttcgctaagaaatggaaccatttatgaagcttagcaactgatgcgaattttgctttgatggtaattatgtaacagagtggcaggggtttcacttccagataaagatggacaatgaaggtcaatttctatcctgtcgttttgaatattcagtgccagcacaatttaattgggatcaggtaattgctcagaaggctacactgagcccactatcatccctcagtgtcgctcctgcacacctacttatcctgatgttgtttgtcaaaaactgtcacaaggaatgtgtctcactgagaaaaataacctgtttgtcattgctcagagcttcaagaccatactctaaagtgataagaaaaagttttttgttttttttttttttgagcaaaactgtcttgtctctgaactgattaaattggtccatcatggtaatataagggaacattttaatgaaataaattatttatgggagttcagtgatatttgctctcctagctcttgtgcgatagtatcaagtgtacctcttactctcttttggcattgaaggatattatattagtcttgaatatcttttgcaaaatattataaattatgcaagtaataaatgtaaacattgttttaagaactagagtattgtgaataaattgctaaaaatttatcttgtgatttttctcattggcattagagagaagcagaaatttagaaactaattcgtatataatgtgtgtttgtataataaaaggaaactatgtgctcaggaacagtctgatgtcctcagaatgaaaatactcatagtaacagtaacatacatatatgtaatgtgatttataaggattgcaacattaaatgtttgtttgaattggcactagtaaattttaattaccacctatgacttctgacttctgtctattgatacgaggactaaaaggatagttaatgttattattagtattaataaaagtaatgtaagtttagtataagatttctaatctgttcaccatagacaatgaaccaaagaggaactactttgtgctacatttttatctgtctcagggcataggttcaagacaagacaatttctagttttgtaaaatgaaagcagtgatacagaagacacctatttcattccctcagattaatagtatataatactatatattatatactttacacaaatgttagaataaaaatgaagaaatatttaaaatgataggctcactactatatttaatagcattaatcctcaaaggcagtatttaatacattaatttcttaatatgcgtgcattgtgaatacatgagaaaaaggaaaaaaattctttaaatgagttcctgcaattaatatcatcaaatgatgtaaattacagttttaaaacaaaaaagcccttaaagcgtgctatgaataaagtaggaaacaaattaaattttaatctttattattattaaaataatctttgcattgttctttttctacttgaagtttcagtggttttcattgatagtcataaactggagagaaacttgtgcccacctatgatactccagaggcacaagacgccaaggcttactgtcttccagcattgcttccattttatgtctggaggagataagatatgggtgtagctgtgaaggagaattggatatgcagacgattgctttatctttatctctgaatgatggacacccaagcagttttaagggagggcctttactggctctcatttgccttgtttttattaggagacagcctctctgggttgcaataggttgcaagttataaaattcaaatgactctggatgagatgctacctttcttaacttaatttgaattgttcatatcaggagtcctttttaaggatcagtcaataggggaacaataagacagtctatgaatcttcagcatgggttacagctggaggacataaaaaaggaggttggaagcactggacacactttaaaaaaatcttgtctgggttgaaaaatgcattttctttgtctaagtcacatgttgtattccatatttagctgtagtgttgaaataataggaaaaacactgtgtcttggcaggtaggcccctgctctgagctggacccaatggtcagagcacatttttgtttaacattcagagggctgtcaagatgaggaagtccattttatgggttttctaccatgaatttgctcttcctggccaactccgctcatgcctgtgaaaagaactcaccagcgtactggagaatgagatactaaactaggacaagagccgctgctgaaaagctcatggctgatatcaactggaaactaattcaaatgactcttacaataaaccagttctccactcactcaaagtgacagtgaagtgaaggaaatcatcctttgtgtttcctttgtttcatgcaatagtttgtgtggttaattcattatagtctttgttctcaagcgaaataaaacagtcaggtgaaagaagagttttcttccttgactttaaagtggatttccttttataacaggtaaaactcagctttcaattgtttttagttctgaagttaatagcagtagttctaggctttttttttttttttttttaaatcaatggcttgttaattgtcatcccagttatttacatgtgactatagagactgcattctcccagctgccaggccgccagggctttgccactggtataatttataacacgactaattaaaatgaatttgcttgcaataaggttctgtgtgctatttgtgggagaggagttattaaaattttcagtacagtaatagtaaacttgaatgcaaagtaataataatcatacatttttaattacatgtttaatacccatttggctaatgtagaactattctgaaaattacttgggatcagcacaatgtctttttgtgcttagtagtatccaaagacatccttctgaatgggcttagcaatatgcactgtcatcaagatacagctgtttgatgacagacacacagtgtgttcctatgatactttgcacaagatcagctatgacaaatacaagttcattttgcttattgcaggcaaataatgtcctttgcaggaacttggatggagccagaggccattattctaagtgaaatacctcaggagtggaaaaccaaataccatatgttctcacttacaagtgggaactaagctatgggtacacaaacgcatatagagtaatggactctggcgactcatactacatattgagtacaatgtacactacttgggtgatgggtgcactaaaatctcagaatttgccactgtgtcattcatccatgtgaaaccagaaaccacctgtacctcaaaagctgtcgaactaaaaaaatataaatttttaaaaatgattcccggctgggcgcggtggctcacgactgtaatcccagcactttgggaggccgaggtggacggatcatggggtcaagagattgagaccatcctggccaacatggtgaaaccccgtctctactaaaatacaaaaattagccgggcatggtggcacacacctgtaatcccagctactcgggaggctgaggcaggagaattgcttgaacccaggaggcggaggttgcagtgagccaatatcatgcctttgcactccagcctgggagacagagtgagactccgtctcaaaaaaaaaaaaaaaatatatatatatatatatatagatagatagatagatagatagatatttttatatatatatccaaatatatatatatttatatatccaaatatatatatatttatatgtccaaatatatatatatttatatatccaaatatatatatatatttatatatatatgagatttccattttccaccaactttcttttgaaaaatttcaagcaagactagtacaaagaacatccatatgtcctccacccaaatttatcaatttcttacatttgctcacttgctcactctccctccatcccctttctcattatatatattatatattaatatataatatataaatataaagtatatattaatatataatatataatatatgatataaacaaattacataatatataattataatgtataaattatataatgtattataattatataaatataaattatataatgtgttatatataatttttatatatctggctgaatcacttgaaagttatttgcaagatgtcatgatactttacttctaaatgcttcatcatatatcttctaagggcaaaatattctcttacatagtcacaacataattatcccatccaggaaatttatggtactgttatctaatacacagtccgtattcacattctttacagttgttcctcactctccactttgctccaggatttaatcaagagccatacaatacattccgatgacatgtccatttgatctttaatctaaaaaagagttttcagcctttgttgatatttatattctttatgttcttcaaggattgctcccagttgtaaatagtttctgatgtttgtttgtttgcttgttttctaagtcaactcctgaagaagcatgtatttatacacaactaatcttgaatgaagaatggtcgttgttaaggacttgatattagcaaactgtattcccaagctctttgctattttacccataatactgcaagacattttctccgactcatttggaaggtgtttccatttgtatctggcaagctattctcttagttcttaataataccgtcattgaagatcttctagtatgtagaaaagtataaagtgctattagtattccaaaggaaagtataatctaaatggtgaaaggaaatagaaacatgggcaaaatcaatacagctgaataaagtttaaagatgcagaatatgttacaaggcaggttagcattaattgctaaccaagtgatatagaacataagtctatattatctgtaatttacatagctattgattttcataaggataaggcaataccacttgtctaaaatggaaaagaattatgttgatgttagaaataatcatttacataagcgtacatgtgatttcaaggacaataagctaatgatggctcataaatatgcatatttttcattgatcaaaactgcgcagtaaacttctggtatctgatcttgtaaattgttacacaacattaaggtaattaagaagagaattaaggcaaataagactgcctttaaaacatacctttgcatggttcttcatcttgaattcgataatcacaaatgtgacaaatctctgtgctaagtttattcagtttaacagttgtaaattaaaaaaaaaatcctccattatgtttatcaagtcttccaagcttttattcaccatttttaaattatgtatttatttgtacaccatttaaaaaaattatatttttctacttcatgaccccagccaaatagcatacaatgtttaactccttacaaatcatacttatttctttatagtatattgacaagttttgtgatagatcttcttttagaattcaataacctaagaattaaaaactattttagagttagtgattctaacttcatgaatcttctgattaataagcttcctcaaatgcattttaagcagaaagaaaattgctgaatataaactaaaactgctcagagaaatgctttttattatgcactttcaaatgaaagtgaatgcacaatgagcccagtcctctctttagtgttcagtacacagctcagggctgtgtattaacccagtgccctctcctttctagctatgcaattagtattgattgactgatagatagcacacttgatgttggtggtcactgaggtacgtacacctctgtacaatgcccgccaggccattgtgtgtgcctggtacgttactgaggaataacaaaacaactggtgagtttttaatcaactgtacatggaatacaaaatgtggtctgtcttcctgtgtctagctacttttacttcgcggttttattttcccagtgatgtgtacactttagatttttttcccagacataagagaaaatgtatattgtattctacttgctgttttaagctttctcttaaaaagtctatacattatatttgtgttatttaacaggcccccatacatagcacttggtatgtttaaaacacctcatttgatgctttataaatatgagttaatttgaaggaaatcatgagcaaaatctcatgcacatttcttttgtgtatgaaatttagtggaggatgtttttgtctacatatcagcttgcaggacttctgctcaggccgcatcatcttttataatacacatgaggtccaatatggcctccttccaatctatctgctgggacaggaaaaggaagctctaaatatctcagcagtaactcccccattccctcattgccccagcccctagaaaccactaatctgttttctgtctataactttgcccattccatatatttcatagaaatgcagtcataccatatgtgaccttttgtgcctgacttctttcacattgatgttttcaagattcagccacattgtaggaattattttatttctttttattactgtataatattccattatattccacattttatttatccatttaccaattgataaacatgtggggttgtttctgctttggtgctattatgaataatgctgctatgaaaattcatgtacatgtttttgtatggatatgttttcaatgttcttggttatatacctacaagtggaattgatgagtcatatttttgagggactgccaaacagttttttttttttttttttttttttttttttttttgtgatggagtctcactctgttgcccaggctggagtgtagtggtgcaatctcgactcactgcaacttctgcctcccgggttccagcgattctcctgcctcagcctcccgagtagctggaattataggcgcccgccaccatgcctggctaattttttttttttttttttttttttgagatggagccttgctctgtcatccaggctggagtgcagtggcgtgatctcggctcactgcaacctgcacctcccgggttcaaccaattctccttcctcagcctcctgagtaactgggattagaggcacgggccaccatgcccagctaatttttgtatttttagtagagtcggcgtttcaccatgttgatcaggctggtctcgaactcctgacctcgtgatccgcctgtcttggcctcccaaagtgctgggattacaggcgtgagacaccatgcctggccgccaaacagtttttcaaagtggctggacattttaccttcccaataaatatgctttcatatttgaactgactgataaaatttcaacatacaaagcatataggaatttttacttcaagttacatctgaaatggttggctatatttaaaagtagatattctgtttttaacaataaaacataatatcttgcttttctatatgactgacattattatgctagatgacaactacataattattggcaaagcacaatttgtagaattacaggaataaaactgatggaagcatgtagcatttcattcttccaaagcccagaatggaaccaaatagcagattagttgcaatattgaggttgaaactcaagttcggtgcatgtctatttcctcctcctttcttccattcccatatcaaaataaaagaaaacaaacaaaatgctttttttttaataacttgtttttcagtgtaaggaaaaaatggtacagtgtgaaagctaaagtacatactagctgagaaaacctgacatgagactcattttttaaagtataaacctgtatagtagataacatttcttgaatgctcgctatgtgccagacacaatcataagctctttcaaggattaacaacacaaggctatgaggttggtattattgttctccatattgtacagatgaggaaataaaggcacatagaggcttagtgtcagagctaataaatgacagaggtggagttcaaacctaggcaggttagctccagaatctgtgttttagctgccattctgtgctgctaaagagcgtctgttaccaccattatcctactagcaactttaaatgcattcatgtaatcattggaaacttcacatgctatagtaatttttatgcagaatttcagtaaaatatctctaacatacaacttccagattcaaatttgcagatctaccattgttatctaaagggtgttttgattgatttgtatcttattttgtgggacagcaggattcagtgagaatttccacagggtggaatcagtattgagtgccctatggaagtgttaactccattccaatatccatagttcaagcaaattgttgtttcctgtgaatgttcttcaggctgttactatatgtgcctgtcatgtcattccatgaaaaaataatgctggccttgtagtttctacaaactttactactatgagtgtcacctctgagtttgaaatatttgaagcaggagactctataagttttcagagataaaattgtgtccagaaaaatatgtccccctttgattgacgtgggtgagcatgactgtgtatcatagattatagtattccgttcactcagtttcctttcaacaatgtctcatatatttcaaaggaaaatgttgccatgtcactttagatttaaaaggttgcagtgaatgatgttttcttaaataaaagggaggaaaaagtaattgtcatgttttgtagatttaagccctgtcattgccaaaatatctgcacgtgaaatcagtagatagaatttttggtagggcttctctgttgtctgaattcccattactggaaggaaagtatgagaaaaataaaatgaatgtctcatttttcacatgttcttcagtagtttggggtcactgtttggaaaatcttaagaaactgtgatggcttgaataagtagtagagagtcaatcactttaacctgtgctatttatctattttcttctaccatcaattcccactatatctttaagagaaaaatgcagcacagaatttctgacatagaccatgttgaagtaccatttttccccatccttgaaatctcaactcttccttaaaaagtgtcaagaaccaggtatggtggctgtgttagtttgttctcacactgctaataaagacatacccaagactgggtaatttataatggaaagagctttaattgactcacagttccacgtgcctggggaggcctcacaatcgtggctgaaggcaaggaggagcaagaggacgtcttacatggcagcaggcaagagagagtatgtgcaggggaactcccctttataaaaccatcagatctcatgagacttactcactatcacaagaacagcatgggagagacccgcctccatgattcagttgcctcccaccaggtccctcccacaacacaggggaattatgggagctacgattcgagatttgggtggagacacacccaaaccgtattagtggcgcacacctgtactcgggagactgaggcaggaggatccattgagtccaggagctcgaggctgtagtgagccctgattgcaccactgcactctagcctgggtgacattgtgagaccctgtttcttaaaaaaaaaaaaaaaagtcaaatagattcattctcaattttattatgtaagtattaggatgagatatttatagtatgatagaatctgaccaaagagtatctgttcagccataaagggagtatgtaataatattgtacgttagtgataatatcaccatcaaaaattatttctcagttttcctttgagtgtacatctgtaaatgtgtatgtttgtgtgcgtggcaagatttgcagatgccaaagtcctataagtgtccttcttcccatctttttatttgaacttctgagggtctgcggtgaaaggcaataaaagcccttaacttcattactgtactttatactaaattcaaacaatattgctttatttattttaattcacgtttagatttgcattatattttgtacaagacaatgggtagaacctaatttccagttttcactggagcagagggtggaaaggaatcagcagtaaaagtgagtcctgattagtttcccctcctcttgctttagcctttgataagtaagcgccttctactttcatttccaacagcgtttaccatagaaataatacagtgctcttctccatttgctgtggagccctgtggttcattgttattatttcctcaggaatccctttaaaggtatcctgcaataatgctataatctcagagtagctttaccccttgccacctatataatgatcatttctagttaaaaaaaaatcatgtggaagagagttgataatattacaaggagaagacaattttcctgctcaaaatgtgagaatttgaaataatagatgtggagagaaatttaagtaaatatacaattaactcttaacctacaacttcactgaaattctgaggaaatattccaaggctgcataaagtgaatgaagagtttcctaccaaatatttctccctcagtacctaagtaattgtttcttttctgaatcagttgcatacacagaagtagaggtggcactaaagataaagatgcttcgaccttgttctcaccactttttttcctgttggtttccagcagtgtcatgggctttcattacttattcaagaactggctgtgctgaacttccattgctactctgcctgtacccacatatttctgtagcttggaaatttgtctttgagtttatatagtgaggatcttttatctgtcactgtgcggtagctttagcataactgcatttagatttagagattaaggcttataacttaattatgaatccaactacatacgaaagagtttaatttaaatttaatattttgattcagcacagctcaactcatgtgttcttgttaaattgtctctcattgaatttttccttgtcattaccttggacatcagtgcttttccagaattgcaggctgtagcaaaataacaacgcagacttgacttctgtctgagctaatcttcagaaagggcacaggctaatggtgacgtagacatctttacagtttgtctgtaaatgtgttgggtgggtgtgtatgtgtgtgtgtgtgtgttcatgtgcatacacagacatatacacatgaatgtgtcttgctatgctaaggcctgaacaaataaaaataatgtcaaataaatatatttacaaagcctaatctgaaatgataaagtagatgaaatttgagaaggaacatttgtggtctcccaattttatgcctcatgcacatgtaactctatatacatatatagagggaacactattcacacaacacatacaaatatacatgtaacacttataacagtgtagttatgtaagtgtttagatatgagaaactactatttataggaatccttcagcagtatctttcttgcctcctcttcctgctcttcctcctacttctcttcctccttcctctccgccacccccctccccacccccgcataaaaagggaatggtttagtcaggtaaataactaaaaattgttatttttttaaataggctttataaaggtgattttatcccagaaagaagtgtacttacacggctatgggggactgatctatgcatataaagcttttcattatcagtgggaaatttccatttgtaattatgtccatcacaacatcagcagcaagagcatatataatgtttcaaaggttagttaaggagtgtttgtgcattttgtatataattagacaaagaagtaattaatatagacttggataacttgcttgcataaacaacattaaagcaacaataatgaacactttaaaatatacacgaatatcatgttaacgtatcaattgccctacttctacctttccctagttcaaatcctaatttaaataatatttcagtgaatataatttttatacgtaaaatttcttcaatatacaaagaattgtttgttataaatttcagtgtcagaaactttaaactagaaatgcattcccatcgaaatagcgtagttaaaccttctctaccaagtactagtgagatgtttgtgtcgagaagacacagaggctgtgttggggtctgtctgcaaactaacattacacagggtagcttcatttggatgtatttttaaattagatccccactgatggtttcctttgaaataaaatgtttctcttattttaaaatgcttgaaaatcaacattataattgatggttaaatttccagtttaagcatacttttccttgttgtactacacatgaagtactgtgctttggcaatgaaaataatagaaaatgtgccataaaagtaattgaaacctaaacagaattgctgagtgggatttttgtttcatgtcttgagcatgttgcttaaggaaagcagatctaattagggaaagacaggaggcagatacaaagactttggtgggaattgtgagcagagaattggggcattttcaagggctatgagcttgagagagtcgttatatccgatttcactttccatttcctagttgttacttttgctacacctacacttattaatcatcattggggttgtttgggagcttacaagtgagttgaagagctgggtaaagaatagaaatttcctctgagttattagaggagcaaagaaggaaaaaaacaaaagatgggagatgggagaatggtgtgcttttgtgtgttaatgtgcctggggttgaagtagttacttgtgagaagcaaaaggggacaatagatcatatgctattgctcatccttttgtggaagaaacccatcaggtatccattcactcactatttactgaacagaacacattgtaagagcacagtgtattaggcgaagggaggtcactggtgaacaagagcttcctggagctttcagtctactggtatcacaagcatagaccaaagaagcacatatcataagtgctaaaagaggtagagcacagaatgagacctcatgataagggcacttattataatagtcctagatctgagggaacacttctctgagaaaataatgtttgagctgacacctgaatgctgaatgggagttaatttatgtgccgagagatgggaatagttcctgacagaggaattagcaaatattaagctgaggagtttgtgttgtattttataaatataaattaggacctactcttccttttgtctttccttattagtgtgataaaatcatcctcctagttacaaagccaaggactctgacagtaatttttgaccctactttctctgccaccttgcacccccgttacctttactctaataacatccttttgctcaataatttttttctctttctatctctaaatctcttctcctacactcaaccctcaatttaattcaggtctgagccacgtattgctgaactcacagctttctcacttccgctagaattgactttcagaagcatttgatcatgacattttcagtgtaaacctattcagtgacacagccctgcctgtagaataagacgcgtcagctttacatgttctcttgatatgatctggacccctcatctcctaccactttccctgtattcttgccacatgcacctccttgttctcttgaatatagcaggcacttagggccctgagtctctaaacatgccagcgtgccctcccttccctaatcatcagtcacaatttgtatcctctagcctgttgctttccagttatcatactcagaattaattttgcctccttccttgtaatcgtattacttttacctgcctctcccccttttcagcatttactttataactctgtcctatattgtagtgtcataaatcattgctctaactagagtttaagttcagtgaggtccaagaatttgtcttatttatttttatattttatgcttttatcattttccacagttggaaataaaaatttatagtcagacttttagcagcttcctggaactgaggcaatgcaggctggggcagagaagaaagttaaaggatacttggagaaacctgaagaaagtaatttagactattttatggtttatagtctctttttgatcagctgtgggtgccctcacaatattggttgttgagaatgatttgacagaagttatcaaaataaggagattcaaacttagtctatatgagaccaaatactcacattttaaacaatagacatttttagtaatgacatttaagctcctagatagctggatacagagccaatgttattgcatataattcaccaattcaacaaatatcagttgatgactcaccgggatcaggtacagttaaaacttgctctccactttggtcatacttgctttaattcattgctaattgagtcttaaggctcaagcagtgggtcttataaattcactggtctttattgttgaatccttctctaattttggcagtaatcacgcatgtcaatcttgcaatgaggagctatcggattttcaacctttacattcaagctcttgttttttcctgaactggctctttgtacaaataaaaacacactggcaaaataataaatgagaatccttttggacttttcagccaacaataaaatattttttataaaaatggaagtgcacaaaatggcagccatctgttgtttaaaaacaacagaactgtatttaagtcaattattgtgtaaggtctgtgccttgaaagcaagggcaaaatggtttatgttcatctcaatgggagaagattttgtgtgcttctttgtcattgtctatgttgatgtgagactggataactattactaactgaaaatagttaatcatatttaatcatggatgaggttgattgaaaaaatgtcatttttatttatgaactcacatggacatgtctaattggacaattctgattttctctctttattttgagtagctttaaatccagacatactagcctagcaaatccataaagaatctgtcatcatggaaattgctaacagagcctgaactttttcctctttccccccactcaaagtttgaaacataggcagattaatagagataacaattagaataatggtaagaagtttttttttcaaatgaagtacatcctaatgagagttaggtttttgctaaaaagtgtttttcttgatattcaataaaattgatataaataaattgtattgttaattttaatctttttttacttggtaaaaatgctttctatgtcagtcatctatattatgccaattcttgcttcattttcaatgtttattagagggattttataaattaatcttgttttcatttatactattgtataaatagttttcatttatactattgtataaataatagtattcatttatacgatatatattgtataaatagttttcttttatactattgcattttatgagtgaaatatacaatatatattctttggaagacatatcaatatcactattgcaacagatatttttccagaggttaacaagctatggctcacttacacatttcgcttaatctacattgtagtttgaaaacacacagatgtgaacatattaccaatattttgccaatataagagtccacatttctgtcttcttttataaagtatatgaggcaaacacaacatatccagactaggatgtagactgtaatttcaaaatatctaaaataggggagtgccgggggaaaatacgtcattttgaaaagatggctgtgttctctgtgtttatagttgaaactataaacctatttctacctggatgaggggtttataagggcaacattactaattttgagtctccacctctacaatgttagctccatgagcgcaggtattgggtacagctgaatcctccaatctaccgcagtccctgcctggcacataagtgatcaacaaatattttgttaaatgaataaatgaacaccctgtctctttttctttcacctaatcctggtatgtctttgctccaatcctctgccacccagggctactattttattagttgatgccagaaaactctccaatgagaatgtcccatgttcttcactgtcataccttttttagactctttgctatcatgccttaactaccaacagcaaagaagccaaaaattcagacactgagatgtggttcagccagaaatatttacaaatgtagaagtgagaatactaagccaaataacatttctcataataaaatgtagactgtaggataatattaaaacttcaaattgtacaggagagataatttgggggaaagagtgtagcactaagccagtgcttctcaaacttaaaggttcacatgaatcacttgggggtctttttaaaatgcaaatttgtatttggtagatctagaatggatcctgagaatttgcatttataagctctcagatgatgctgatgctgctgatatatggaccacactttgagtacctcgatattaagcaactgtaaactatttgtttgaaaacagccatgatttgaagctatacatgataaaatcgatgggcatttatcaacctgctgaaaaaacttagatgtctacaaatgtccaaatgggagagatacttggagtaagaactttgtagtggtagaatggcagggacctgagatatctgttgcttcaatttacaaactgggattctggaccccaaagatactcaatgacttacataagaacccacagctatgttgatgctgcacccaattggaaccaacgtttatttattcccagacccatgctctttaaaagagatcatgcacatggacataaagaaggaaacaataaacatcaggacctatttgagaggggagggagggaggagaatgaggatcaataaactgcctataggctactatacatattacctaggtgatgaaataacctgtacacccaactcccgtgacacgcaatttaaccatataacaaacctgcccatgtacgccctgaacctaaaataaaagttggagtgaaaaaataataaaaaaataaaacagatcatgctgcctcttggctattgaagttatagtagaattccttcaataaaacacttaggaagttgttgtactataaaatatacttaatttcacttaatattgagtgcttcactaaagtcagtcaaaatgaaaggaagtaatgcattcgcttctcatgagttgcatttcttgtgggtaacatatattaattttattataatttatcttcattagctattgaaaataatgctaaagacatttagaatgccttttagcgggcattactgaatattagatgatgaacagctttgttggaatagtttgtttagttcctaggagaaagtttgatttgacgactaagtaaaaaatttaggggaaaaaagcaacaaaaaagtacccaaaatcaatatcactacgtttgctgacgaagggtgtatttttagctacactgattttttaatttaaaaaaaatctacacggatccccctcaactccaatgtcaagtaagctcaactgacattatcgaaaccatcttcctttttattatcaaaaccatcttcctttttactgtgcatgtgtgtatgtaagtgcaagtgttacaaattcttaaaagaagataaaagaatgatttttcctcattatggtgtaaaacaaaattaaaaattgaaattatctaatctgcataaattagacactttatattacattggcagttttatcatatttgaaacattttgttggtctcaagatttaattagattatgtcaccaaatcagagaccacaaatatccatgggagcttaatagaactttttggattttcatgggatgaaaacagtattttcatgaggcgcagaattcatcatcagcttctcacctccattctaccctcagccttctatttccctgacccacattagtgttatgagagcaacaaatggacgtttcttccaacacaggttgtaagaaagtgctgctatcatgtgaggagtataaagggaaaatcaggcagcataatagctgagctaattaggctcagaccattaaagatcttataacggttatattattgttgttgttaatatcacctgagtattgcctcacagattacagaatgcctcctcatacattattttatatcacagattataaaaggctagcattataaataataatcatattaaagagtgttattttaatattacatgagacattgattttcagtgatgccatgtgtttccatagtgactatgataattaattgctataaaatcacaaacagtatttccttttgagagttgacaacagatgctggcattttaacaaagagtatattaaataatccacagcatgcccagaaaattgaaatgattaccatgaattaaaaaaacccacaaaactcataacaatgcttggtgatacctagaatattctggttatctgtaagttttcaagaaggccaagcaggcctctgtcactgttctttacctgccaatcacaccgataacttctatgagacatttctgtctttgagctaatcatcctctttttaacagcatacgcattccaacaggcatggaaactataatgtattaagccattttatctgcaattctcacttgttgtgatttagtttaatctgttttctttggttccaagtataagccaaaatcaggacacagagaaggggcatcttgttaataaggaaagaggatgaaatggcagaaaagtagtgactccccaggtgcaaataggggaatatcaagatgtgtcaagaaatgaataggcagcccaaaagccagatttgtatggaaccttttctgcctttgtgcctgaataataaccataattcctaaataaatcatatgactacagttgaacagtggtaacttttgtgtgtagaatgctgaacttctaaattatttttatactcttcgtcaaatgcactttaaaattaaatagttgttataatatagtatgccagcaaatcccagattgtcttgcagagtgactcagaactcttgaaaggtcactactttcgaacttcaacatccttaaaatcacttgaaaactgactgctgctggtgtatgtgacttgaaaatatattttgttgagaatatacaatgtttcttgttctgtgtcaattggctacccacattcaaacatttggagacctcccataagcatccatttttcttttaaaaaactgaagatctagcagtattgggtccacgttctgttccagctaagtatcactacctcctttggaagggatttttcctttccagtctcccaggtcttggtaaacctctatcttccttgaatacaatagatctggcacctattggcattcagtgtagaagaaatggcattcctataatttgatcaatgcactgattgattggttgttttagaaagagctgaatgaaacatttcagtttcgttgttgatccatatctatctgtctgtctgtctgtctgtctgtctatctatctatctatctatctatctatctatctatctatctatgtacctacctacctacctacctatataggtaggggaggagagagagagaggcggaacataaatcatggtgtaagttacacttttaaaaaatggaccaatttaccattgtacaattgtaaagactgcgttgaagcaattttaaggataattcagaacatatttttctaagtaaagttctatgtcttatgagagtagaaagcaatgaagaaatatacatacattttgcgtaacctagtggcccttaatgtataaatattgcatgtttaagtgaagagtcatccatcaagaatctaatctataccagaagtatacacttcctcttttatactttgtactaaagatataaatatgacgtgttccctagttctctatccattacagagtctggtggataaaaattaaaaatataatcttaattaaaatggaaggggatgaaggctataagacagtcaggtacacacatactatatggaaaaactgggcagaagtaattctgtctcatatagtctgggaaggtcccatagaagtggtcatttagctgattcttggaaaaataagtagtaatttatctagcaaaggatataggaaaaagcattataatgagaggaaatggcataagcaaagaccttgacatgtgaaagttgattttatatctataaagatctctgactgaggaatattgttggaaatgggggatagtgaaggcagatatatgtggaagataaaatgggttgatcgtgacattttttttttttttttttttttttttttttttttgagacggagtctcactctgtcgcccaggctggagtgcagtggcgggatctcggctcactgcaagctccgcctcccgggttcacgccattctcctgcctcagcctcccaagtagctgggactacaggcgcctgccactacgcccggctaattttttgtatttttagtagagatggggtttcaccgttttagccgggatggtctcgatctcctgacctcgtgatccgcccgcctcggcctcccaaagtgctgggattacaggcgtgagccaccgcgcccggccgatcgtgacattttaaagagctttcttttccttttcaaagagcttgggcattttattatagacaataggaagtagaaagtggttttacgggaggctatgaaatgatccaaaaggcaactctggctgtagagcagagtcctgattagaggagggaacaaatgaagtcagggagtttattaggaggctttaggaattggccagcgggagaggctgtgagtaagaacgaaagtgattggcaatgggaaggaatcagaagataaataactgaaagatattactgatgaagaaactttccggattggatgtgggcactcagaggatgagatgagttggaggtcggtagtctgggaaaaagtgaagaaatcatgccaaaatcaaaatcataatgtctagaaagggaagtattttccgcagcatggataacagtccctgggtaatgtataaattctctgtcataaaatactatctcccacaaatgttaattaagtatttgaaccaaaagttatttggcattaattgtgatcactgctattattgttattgttgatattatgagaagtagtatttagaaaatgtgagcaatctcatgctgtatatgcacactaggaataatgctaaaatagaaaccaaactaaacaaaaataagtaagaacaaaactccgatttaattcaagaaacatgcagattcatttttgcttggattttctttgttattctaaagaatcatgaaccaatttttttttaagtcctaactattgctatcctggagaacacttcaactacatagagtaaccatttacagaatacagttgaagtctacagctgctctggaggataaatgcctatttcttttaaacgttggctgaggccctctcgaattatatacctcacatgtgctgtatttacatcagaccaccccaaacatgctttccaaattaggttaaaatctgtgtcaccattttcatgtaacatagaaacttaattttatttatagagattttattcattttatcacatagttactatttgccttcctggtttatgattccagtttctttggaattccacttttatgtgactaagtaccctatgtgtttaactctactagatatcccatcactaaaatacaaccataccttgggattattcagttctttggtaccccactatacctcccattaggtgagtttctaatgcaagatactgaccatagtatgatgcattctgaaattgccttggctattcatacacaggtatatgtcttatatttgaaatgtaatagcattttgtatgttataagcatgctaatttgggggcctatttattgtaggagtagcaaaaaataagattgtacttttgaagactatatgtggatacatagtatcatgaatggctgctctattttgtcaaattcagaattaaaataagatttaaataaaaatagaggccttttcagtttatggattttcttattatcttaaaaaaaaaaaacatgatagtgaggtttccagctgagaggaatggttggaaaaacattttgttccagttagttaattcttccctacatgtgctctattcatcgtatccattttaaaagcaaatgaaccatctctatctcctcttgcatttgtggcaaactcttgctgtgccaatttcagattacatgcatcttaggaagaataagatgttctaatcttgattataattttaagttaaaagaataaaattagttcaatactaagacattgatacgttgcagtagtcagactgtcattacctcttttgacaaaatagaaaaacatgtctatacacaggataataagttcctgcattaaaatgcataatactataaatgctactagatttcaacgcaatcaagaaatcagtttatggaagctgaaatttgttaataaatatgctgctacttgagagtttaaccattttgcaaataattatagcaaacttccaacgaaattattttcattatgaatggagatactttccaaatgaggatataagaatagataataaacacatgaaaagatgctcagcaccattcttcatcagggaaatgtaaattaaaaccacaatgaaaaactattatacacatgttagaaaggctaaaatctgaaagactggtcataccaagtgttgtaaggatatggagcaagtagaacacataagcattgctgttggaaatgaaaaatagcataatcacattagaaaatgcttgatagttttttaataaagtttgatagtttttaaaaatataggtcatggacaaatagatgtatgctttacagatgctttatacatctatttacccataacccatagccaacattgtaatcccagatgtgtatcccagagaaataaaaatgtatgtcaacacaaaagacttgttagtgaatattcatggcagctatattcataatattccccaactcgaaatgaataaaacgtgcatcaataggtgaatggatagtggtccaaccatacaacggaacacaatttagcaataaaaagcaacaaactacagatatacataagactatggatgaatttcaaaccattctcttgaacaaaaaggccagacatagaagtacatacacattaatatgaagaccaagctctggtgacagaaaacagaccagtcatcgtctgctcatgggggaatcttctgagataaggggaatattttataccttgtagcttagaagaaatgttatagagccccaaacctgaacatggagaagtttaattttgaattatgagacaatctaagcattcaggcttcagagattttttttaaaaaggcgggcgggggggtggggggaggccacagtgtgggaacattggaaagttaggactagaagtctcttgtgaaaatagaaacaggaatgaatggaaaagcattcattcataccgtcaacaaccgaatagttgttagagtacaaatgatgagccagactgttccaggcattgagggtacagatgaagtacctggcctcatcgaacgtacacttacttagttgctgagacatacagtacacaatgtcaagtaaacatgatgaacacagatcagtaatataaaggaaataagagcacccagacaggaaggatggcacagatccatttttagagaaaccctggggaagggtgtaccaggtagaagaaagagtgaatgcaaaagacagagggtgacagagggtgacagagagctcactctgcttcagatttgtatgataagtgtggaaagcctacagaggcctgtttctgttggagcttgaaggctaccatatggtgtttgcattttaaccaaaataaaatggaaagctattgtggagtttcaagttcgagagttgcattatttatctgtgccttaaaaagatctcttttgtttaatgtgtggattgagggagggagagaggaagaagaagtagcaaataagctcgtaaagtctaataaaaagaaagcagggaggcaagttagggagttattgcaatgtgctggatagcaaatcagggtatcttgactcatcgaggtggcagtagggataaagggaagtggacagtttcaaaatacattttggaggtagacgtggaaggacttactaacaaataagatgtggaggaatgagtgaaacagacaaatcgaggagatccatgggtcttgcctgagattcttgccatttacaaagatggcaaggtctgggtgtataaggcagggatcgggtgaagagagactgtttacaaaggtgcagaaagtgtataaggagaacagcagtgatagtgatgtactcccaggcaagtaccaatgaggggtcattactatccttagaaaataagtagcaaggaaaatgaaccattagggtacttgtacggagaagccttctcctaggagatgaggtcttcagtagaggaacgcagcaagcccacagaaacctgggagaggagcctttgttcttatagctggggaacattctcattgaccaaacccaaccagaacctggagagacagggtgaatgaggggtggtgggaaatggaggatgagggggctggagtacttagagcaaatgagagtaaaactataagggcaaagcaagagacctggcacaatgcccatattctgaattctgtataatttaaaagttcagtaaacttttcctaacaatctaaattacagccaacaacatacaaattttgcaacaacatagaaacttttgttgccaagaagactaatttggaaggctttgctagttctatattagtaatgtgttattttttgaatacctagtagaggaagccagtcccctgaaaagtgtccttgtaagtagtcattatttagttaagaaataacccaccaggaaaaaaggaaagagaaattatgagatgcacaaaacctgaagacaactttagtgttatagaagatcttgagagtactagacagatggaagtggagaatgcatccgtttctttaccattaagaccttgcctaggtgtttttgacattttgagctgagataagagagtcgggttttattccatatgcttaaagtctttactaggtttgtcagtataacttaatgtttttagttaccacatgtcattctgttactacattttgctagaattgcctaacataaacagtatccttatgtttcataatacaagctattcaagggtcatattggctaatacaaactgtttagaaagtttgttttgccagaagtcactattgtcaaagcactgattttaatttttggtgatacccccatttaaaacagatatttaatgcttgcccagtatttgttgctcaatgatactttattgtctgttgctatgcactgattgattactgacagacagtaagtgcattggaagaaaccatgatttaaattgtgtgtgtgtgtgtgtatgtatgtgaatgtataaattattcagtgaagcaatagaatctgcatttattcagaaacaaagaacattcattgattccacaaagatttattgagtgactactatgtaccaggcactcttttagggacgtgtgctacgtcagtgaacaaaagagacctagattctcgtgcttgtagatataatattctagtaaggaaacacagacaacaaataatacatataataaaaataaatcatagtatgttagaaggtgatatatgctaagaaaaaaatacaacatgcacaaaatgaagcaatattcatcaaggtcatgaagcaacattatctgcactctaatctgatctccttgaattcataatggaagctgttgccgttttcatatacatcaattcttttttccctttcattttgtgataattgtacatatgtatggggtacagagtgatattttgatacacatataaaatgtgtaatgaccaagtcagtgtcatccatcaccttgagtatttatcacttctttgtgttatgaacattcaaaatattctcttctagctttttgaaaatatacattcaattatttgtaatcatattcattctacagtgctatagaacagtagaactttttcttactatatagctataaatttgtatttgttaatcaacctctacctatccatacgtcaatacttaaatggtcaaaccaaaatctttatcagaaatcactggtactttcatggttggtatgttaaagtttggatcactaaataaatttagagtaataggctgatcctaaaatttcattgataaacttgtcataattaactgtatttatgacaaagaaagcaaaacagaataatttagataattttataataaactagttcaggatatgtttatcctagctatatattggtgcatcatttgtcttactacatttgcatatgcttaaggcactgaatctggaacacaaaggaaataaatgcgcattgttcgttttttaagaaattctattcacatgggttttaatccacagagatgcctccttttagtcttgaatgcaaaaagaaattatcttttgagtgcgtgtgttagctttgaaaaaatacattcacatgagatttaattcaccttaaagtttcttttctattaaatctcatgaggaattgctgaaggaaagtttcatgatgccaagtcactaagcaaagttctccaatatgacagttgttagaaatgtgaacctagtgcagttgtccccttaagctatgggcaaaattcccagttttgaaccctgaactcattcagccaaaaaatctatattatgctagtgtctattacatgtgacttccttttgaccagctttttctatgtttagactctcacttttattccaaagtacactggaaaatagaaaaaaatcggataattctgttctgggtgatcagtaactttggaaaaattcaatttgtttgttttttttctggcaagagtttgaagtaaaacaagtttcttttcaacacattgaaacaacctattttctccagagcaatagagtttgcatctgatatcagataagtgattcttgtaatttgtctaggctttcaacaaactggtgaaaaaaaaatctcctttcatttactttccatctttcttcatgagtttcttttttttttttttttttatctcaaagtgttcttagagattgggggttgactatctagctcataataagaatctaacagaaaacataccattaagcatttgagcttctcagatcaaaatcaatatttaagaccaaaataatattatgcaagcttttctgatcataaaaagaaagatcgttagtcactttggacagaatgatgatatctttagtcattgaattaaaattcataagtgtaatcctcctgatgaatttttctctgtctggtatttttctatcaggtttataactcatgaggctaaagcaaattagtgtcaacgttttatcatgaccatttactcggtgcctttctgtttctttacgaaaataaagttgctttttaatgttttggtaaatttatataatttctttggaaacatcaccactaggatttaccatgaattacagcaatatacttagtgctgcttagaaaatatttcatccctttccctgttttttgtgtaggtttatgtccttttaatttctgtttaattccccttatttaaagcctaagtctcaaatattcatgattcttattgcgaactataaaatatgtgcttaatgccattatccttttaaaatcatcttgaatctttatagtttaatcacacatcttgcctgtaactaaatttaaaactctctggtaaaacaaaatgcctaaacatcttgtataatgatatgcctttttagcaatggttacacttctggctttataaaactatattacttagctttttaagttacatatgtccattatatgtatctaataaaattaaaccggattttagatattgaacatttttaaagccaacaaccttggtgctatccttggtttttcctctcctactgcctctgatatctaatccatcaattcctattagttttatctcaaaattgaccctgtctctgtccataagtcttctgtcagcctctttattgcaagcttccccactggtctctcattcattctccacacagcagcgaaagccactactttacagtaaatggtgtgaatcattcttctgcttaaaactgctcaatgacttcctggaatcaagtccaaactccttatcatggccgcctaaggccagtatatataactggaccttgcttctttctctgatctcatgtcctgccacttccctttcgggtcgcgtaccaagctcattttcatcttggaaccttgactcttggtcatctctctctactccaaagctctttctctgcatcatggtttctgccttctcatctctaaggtctcggatgccacctccctaaagaaaccatcttgcccgatgtagccccaagtcaatctctcttaaatctctctattctatttattttataccagggagcgccatctgaattacttgtttatttatttgtttgcttctccacctcccccaaccccattacaagtttcaaaagagctcctatctgactcagtgcaatatccaacatcctaagttggatcctggtgtataattcatgctgtttacagatttactgaatgatagtatattaatatgtcaagattcatggcaggtatcaaaaaattaatttattgaagcattcagtctcaaacattttcttttttttctttttatctttttttttttttcagatagagttttgctcttgttgcccaggctggagtgcaatggcgtgatctcggctcactgcaacctctagctcagagttcaagtgattctcctgcctcagcctcccgaggagctgggattacaggcatgaaccaccatgcctggctaattttttgtatttttagtagatatggggtttcaccatgttggtcaggctggtctcgacctcctgacttcaggtgatccacccgccttggcctcccaaagtgctgggattacaggagtgagccaccatgcccagccttcttttttttttttttttttcttttgaggtgagtctcgctctgtctcccaggctggagtgcagtgttgtgatctgagctcactgcaacctctgcctcccaggttcaagcagttcttctgcctcagcctcccaagtaggtgggactacaggcacgcaccaatacgctcagctaatttttgtatttttttgtagagatggggtttcaccatgttggccaggcttgtcttgaactcctggctcaagtgatttgccctcctcggcctcccaaagtgctgagattacaggtgtgagccaccgtgcccagccatgtctcaaacattttcatcttgtgaagctatttaagtttcctgaaaatcacctcactcttcttgtactcctcttccttaaaaccaacccaatggtctcaggcttttctgctcattcaagtcacatttcctcccagtaaacttaattttggtaaaatattcaacagttcaggagagatacataaatcatgcttgaactgccttgcaaatagcaaaggaactgactggccatgtgctatgatttcaagggttttgggaagcatctacctccaactactggtcctcactgagtcttgaaatcccacatttagagttttaatttcttttttttaaattaaacaacagaaatttattttctcacaattatggtggttggaagttcaagatcacagtgttggcagggttggcttcttctgactgctgtcctcattagaattttatttaagttttgactcatgttaagatagaaatactctcggaatgattaatgctttaaacttgtccagccacttagatgtaaggtctgaggatcttaaaaggtattttgggaaggaaaaaagagcaaacgtcagaataccaggaatctaaaatacaggcagaagagccacctggagggtggggaccattcggaaatcctgatctgcttgtaaggccggtgttagtctaacctatagcattctggttcttttctggctcggctcctactgtaaatttaaacatcccatttaatcattatgcaaaaaaaaattaagagatttagctgggtgatctctaaacaattctagatcagtgattctatactccataattttattcacaatcaaccctttctactactcacagatgctagaaaatattagaaagcagatgtaattaaatgttcacaccacaaaaatgagaactatgtgaggtaaggcatttgttaactagttagattgacccttgcacaatgtatatatacttcaaaacatcatgttataaacaattaaaacataattttaaaaagccagtatgatttctacaaatacaataacatgggaccaaacagcaacagacctcgagttcaccacatattttatatatttataatttcacatatactcacagtgtttcattccacatctattcccaaacttgaatgcatgtgcatgcacaaacaacatatacatcacctccttcactgagaaattacagcaccattatttattcaaaggcactaactctgacaagagtgaaacagaaggtacttctctattatatagtgtctattttctgattttctttgttatatttcattgtatttattaatattaggttaagcaagaatgtacaaagccatagcaggttgggaaggttatcaagagaccacctattctttttcttcaattcaatctcttttcagattaatcattcttggctattctgttttttaagtaatttactttttcttttcacttactcacctaattaatctattaacagagtgtcaacaattgctgtttcactaaaccagtaaaagacaactgctttggtgataatgttttattttcaagcaggtcatgattatacttatcacattattacacttactacatttattacttatcatatttattgcaataatcattatcacaaaaatgatccattgattctaactctcaggaggcactcaataaatatttagtcaatgagtgaataaatgcaatattggaattaaaacatactctcaacatttcaaccaaatgctttattacaaagcatgggggaaggaagcatagggttggactttgtgcactgaaacagttatatattttccgtagcactaaatctttttctcattaaaatgcatataatgtgcagctattgctccaggaggacctgctgtatcctgttaaaattaccgtcaccaatctgtggattagctaacagtaggggaggatatggctgatgtttgtctgtgtgtgtgtattttgatgattgaagaaaagaagtaatggggattaacattctgcttttacaagtataattgtaagtttaacacagggacaactttatttttagtgtaatacatctgtgaattatgaattatgatatgttcaggtcatgcttttttgcattcattttttacttttatggagttggagtaaactaacccaatctatgaatgaaattcaaaactgtacttgaaaatgaaggaaaacggcattatttttcaaatattgagtataaattatcacaacttcgttaaaaaaaaagatactttagaagtatacttaacttagtctattacttctccaaatagatgttttaaatgttttaagcatctgctgtaaaaattaacctaggccaatttggatattcagcaattatcacgttattagagcaaagtttggtagaattctacaattagagacaggtggatgattcatggcaaccttttctccataatcttgctaccaggtggtatgctaaaattaaagcaagcctgagattaaatagaccaaattctgtcaaatgtaccaacatttagtcgcaaatagggcacaaaagcagttattgaacttaagccttcaagttctcagtctcaatctgtaggaacttccacaaatacccttccaagagaggttcattatgaggaagatcagccagccttctgagttacatcagggacagaatcttccattaaatcgaatagagggtagaccaaagggagtttagacctagacctagtgtacttacctgatggtattagacttctagccttgatgagtcttatgcctcattcatgataaggctcataaaatctatatagcaactgaacattttgaacaccactcatttcatcaacaagtaatgatttcaagcatgccttttgtgaattaatgaaacctctctgtagattttgataatgatacttgaaattcttgggtggcatttttagagtacagattctggattagggaacataaaattctaaccaccttaggagtaggaatcaaagttaatatacagatacgtaacttacagtgaagtattttaaagtaaattagcacatctgttgcacaatagctttccggataggtttgaactataatgttacatccacattacggagatattaattgaaataagtaatacttcatagatatcctatacatgttatatatctatatctaaatcatctatatctatctattacatatttatcacctatttacctatctctatacacatatcattgtaggagtagaaatcacagaaaatgagatcatttgaaccaatggcctggtttgtgtcatttaaataatcttaaatttcaaccatataaactctcagatactcaaataatgcaaattctgcaggtatctggagtaatcgcttccaacattttttgtttttgagacagggtctcactctgtcacccaggctggagtgtagtggcacaatctcggctcactgtagactcaacctcctgggctcaagtgatcctcccacctcagcctcctgagtaactgagactacaggcacgtgcctccacacccagctaatttttgtatttttagtaaagacgggtttgtgctgtgttgcccaggctggtctcgaactcctggactcaagcgatccacctgcctcagcctcccagagtgctgggattttaggcatgagccgctggggctggcttctttcaacttttaactctgttgactgcatataactttttcatatttaagaaatgtgttggttgttgaagaagaccaagtctgaactcaaactgggttcttagaaagctttgaaaggaaaacagggacaaattaagtgtctgcctctgcccaaaggggaagtccctaaaagagaaaagtttaaagacatcaagaatagttctgatgcttgcctaaaagttaagtctagaagtagagtaataagtaaagtttcttggaaccttttcaatccagctagagagatacattatgaccactgataatggtgtgctttctacctctcagtttaccctttgtaaataactcaaatggtttgctttgaactggcatatttatttattttccctctgggaaaccacctctactcatattcccgaataaactgttttcctataatcagctatgtatgaaggctttagatatcaacagaactttccataatatctcttttaaggtgaaaggttcagaataaatctacctaagattaaatgctccttaggtggaaccactgagcctcatgctacctacatgcctatgacaaacaaatttttatttcatatgcatactctgctgaacaatgacttatatatccaaatacctactagaaatctactcctgaaaatccagcagacaattcaaccacaacattcaaagcaaaaataatggtttcttgcccagcccattcttccccatctcaattaatgtttgcaacacacccactgtgactcaagccagatacctaagagtcattctctatttctctccagcccttatacccaacagccaatctatcatcatttcttgtgagttctacctctgcagctattcttccagtgcaagcctccatcacctctcacctagaatgttgtatttgttatattttaggcctcctttctttctactctagctctgtttctttggtcaacacagcaaatgaatgataattaaaagaaaatgaaaggatcatatcacttccttatttaaaactctcttttagcttctgtctaaacatggaaggatcaaaatccctactaatgccctgcaaatcctgcatctccaatctcagtttctcacatcccatcaatttcctgttcactctggccacacagtctttcctcttgtttcaaatggaaaattgacatagcccaggcttaggagctttgcactcactgttgcctctgcctggaaaactctggcctctgagagtcacctgtgtggttccttgatatccaggtctcagctcaacttttacactactgtgagaacatccttaccaccttttcttaagtagctcagcaatgcccccaggcaggcactctctgcatccttaccaaccttctattttccaggggattttttactaagtaaaagtttcttgtttatttagttgtttggttactgtccttctactctaattataatgtaaattccctaaagtcaaagattttgcttctcttccgttgtactctacttgccttggcacatggcaggagcccaatgtgtttcataaggaaattaagattcctacctggtaaggttattctttcaagaaaaggagaatccaagtgacctttttccaaagtggttgaggtccttggtatcttgctgacttggcagaactgttctgagagcctcagaaattgaaccacgttatttaaattcaactctgaatgtaaagagtcaccaaggggccactaggatgaatcccagcatctctcatttcctcaggccccctcatccttctgtttgttaaatcaatgctggaggaagatgggtggcatcacattcaatgacaaggatgccctgtgataatttgcatcatctccaaagaggattaaaaggggctgggtgcggtggctcacacctgtaatcccagcactttgggaggccaaggtgggcagatcacttgaggtcaggagttcgagactagcctggccaacatggtgaaaccctgtctctaccaaaaacccaaaaattagccagtcgcggtggcacacacctgtaatcccagcttcttgggaggctgaggcaggagaatcacttgaacctgggaagcggaggttgtggggagctgaaatcgtgccactgcactccagcctgggcaacacagcgagactccatctcaaaaacaaaacaaaacaaaacaaaaaccaaagaggactgaaagggatttattaaatctcagcgccccaagccagtggttctcaaagtgtggtccctgggccaggagcatcaacacaactaaagaactttgttagagacacagattatcggggggctcagccctgacttggagtatcagaaactttaaacctgtttgaacaagctcttgctaaaatatgagaactaccatgctaagacaacagtgccaaccttgattgcaccttatgattacctgccaagcttttaaaatttatcaggcctgagcccctctgctacaagttcttagtcggtctgccgtgagtgagatctctgtattatttaatttctactaagtgatgctgatggagctccaaagtttagagtcattgccccagtgtgggagcagggtaacttcaggtttatccaggtactttgtagattttcatcctgaaaagaaatataatttggaattcaaacatggcttgcctctcggttttatagtaggagagaagggaaatgacttggcctaaaacacagcatatggttctaaatgctagtgttgtatagcctcatccaaagcatcaactcatagagaagtacattaaagcagtgtaatgttcaaaaccaagttccatagtaagcatctgctataatagaatgacttattccagaagggaagtttcatttcaggagagcttatcatgacatcaaatatgttttgagttaatgaaaatgcaggaagcaccaagttaatagggcaattttaaaccataaagcctaatttaactgcgctaagaatgacaatataatgctctgcacaaaaggaagtttcacaacctgattgatcaaatggagaattactaggatgctggatcgcatcttccttgaagaagctaagttgactaggagaggcagacttccttagaatgcagttatgtacttcttaattaaacaaagaatgattaaaaagagattttgctttataaggccacagaacagcttgtttgataaaattgttataagcctccagactttcatttctactttaatattgattccattttcagaaatagttaagtagaagttattcaggttcttctttatatatttgcttttttagttgttgttagacgtaagataaatttgaaatgtcaggaaggagaatgtttattttcacaataaaaagcttactctgtgtaatattgaaactatccattctgatataagataatgttttattttggctgcttaatttcaaattgaattatttaatagaacaattaaaagtcaatacaaatgaaacagctacttgtttttctcagtttatggatgttttataaagtgtaaaagcagctgtttcgttatacttttcttgaattgaatagccataagagctttcttaaaatcatatttgatccatagctctttcttttatagcttcttctatataatttacttctaagtaacatttcctttacatataaaaattgattattactgtcttgtgttaagaacttttcctgggtctccttaattcatcagaatgccaatattacgattagcaaaaccaattaggccatttatcgcagagaatattggaaatgtgctatatgcaaagcattgttttacaagtagttcaacattctaattttgaaattagactaagagcataatacatttagaaaatgtggatagttaagtttaaatttaaaataataaaaagtcaagaatattacaattttacttcctcagtcacactaggcacatttcctagactcaataggtgcacgtggctagtggctaccatagtggacagtgaagatacagaacatgactatcatcacagaaagttttgttgggcaggcagtgctgtataggctagttagtgaggaaatacatttttaaaaagcattgttccctggggcattacaggataaatttaagaattctgtttcataaggaaatattatgccacacatggagtctttcttaaaataactgaccctctagaagaggaggcctaagtgtacaacctgttcatttcctatcggagttggttgcctggaaatgttgtacatctcagtttcatagcaaggtcataaatgttttgtaggccgtatcctctgttctatctactatccccacagcacaaagaaataattatgtgcatagagtggacacccaatgaatctttactaaaagcaccaaagtaatatgaggcaaggagatactacacagatttcaacctttgaacttgaacagtagtttgtaactcctggcccagtctagtactagattgtagggtcctgatgaacaactgtaggccaggatctccctctgtttcaggtgccttgtggtaaaatcacatgaccactgaaccctcaaccactccctgaactagatgctaccaacaccaacacagaacccctttccccataattccttccttatccctggtccaggaccagccaacctgaacatagactgacaagcttctcatgattcaattatctaacttaagttaccatatgacttccttcaacaaaagttacccattttaaaatctctgtttctttctgtattataggagactcatatcccaaatacacacacacacacacacacatgcagacacacacacaaacacacacatttatatatatgcagaaaagcaatgataaaatctctcctgccaaattagcaatatagttttgtttcaaaatatttatgcataaatttcataaggtattctgacttttaatttgaaatttaattcaataaagattacattagtcagaaaaaactcatctttggccaggcgcagtggctcacgcctgtaatcccagcactttgggagaccgaggtgggcggatcacctgacgtcaggagttcgagaccagcctgaccaacatggagaaaccccgtctctactaaaaatacaaaaaaaaaaaaaaaaaaaattagccaggcgtggtggtgcatgcctgtaatcccagctactcgggaggctgaggcaggagaattgcttgaacctgggaggcggaggttgtggtgagccaagatggcaccgttgcactccagcctgggcaacaagagcgaaactccgtctcaaaaaaaaaaaaaaaaaaaaaaaaaaaaaaaaaactctccgtctcaaaaaaaaaaaaaaaaaaaaaaaaaaaaaaaaaaactcatcttttaatgttagtttataatttaaagacacaaaaacagcttcgtttctagattcaagcaaggcatgtatttccaaaatatctcttcatgattgccccaaatactggatctcctttcctgttggactgtatgtatctaaaatgtacagagattattgaaaaataagttaggatagggactattaacacaattttgttctgaaaatcttcccttaatacatcacatgggtttttgaggcagatgtttggagggcatgatttttagggcagaaccagcacaagttgcaagcaatgcctggacacctgttgagcccttctgtgccatctgcttaaagggaagtacacataaccttaaaatcgttgctgcttttggaggtcattttatcaggattgagactacatcccccacaacccacaggacttaaaaagagagagatttatctcagaagggcattgtctctaagtgtgatcttcatttttatgagctgagcttgaagtccctgacatttagaaatgatagtgtgttgatgtgaggttctttcgaataatccttctaagttttatcagctttgcaaaatgttactaagtgctagcatttagtttgtgaaatgttttaactattgagaaggtgatgttggtcagtccttaactaagatcgatcaaagtaagttcagtaggtgactgttttacaagtggcatggtggtggtgttcctcaaaggttttggagagatacaaaaggactctctagttgtggttttaagttatatactcagttttatatcctgttaaagtttttataccatattttaaaattgctgtttggaattacaggaaatgtttaattcacaaatcatttatagttacaggaaatataattctattattgatataatgaattgaatggtttttaatacatcgtagttttaaacacttaaatattcacgagtaatatttgggaactttaagaatagcatccaaaaggtctacgtgttcatgtgtatgtctgtgtttgatttggtgggggccattggccaaagtttgatcccactcatttgaacagcttgctcagtatgtgcatcattggggaaaaaaatcggcatggagcgttcggtagctagcctctagtagaattatcagaggaaaactgtgatggtgaaactgagaatttgaaaagccagattgatgttttccaagcttgatttttagatgagaaagtaaaagagtattttgatttaacatttgaaattataatattagtagcaataaaatataccagtgcttctcaaattatctgaggtggcagaccaggtttttaaaaatttcattttgctttaattttcaatctctcaaggaccaatactttggtaaaataccataaatatcaataactagaaacaacgatgttaccaaaaaaaagacatacaaaaatacaagccagggcttttaatattttttttcatttaacagatattatcaaattgctgtgaaatttactaaatgttcactctcagtttctatacttttattgtagaacaacaaaaggaatttgttaactggctgtgctctgtaggctttttaagtagaattgctctatgtcactgtgcattaaattttgtgtttggatgtatcctaagcaagctatgaggtctctgaggaaaaaattatatatatatatatatatatatatatatatatatgtgtgtgtgtatatatatatatatatatgtgtgtatatatatgtatacatatatgtatacatatatgtgtatatacgtgtacatatgtatacatatatgtatatatgtatacatatatatgtgtatatatgtgtacatatatacatatatgtgtacatatgtatgcatatatgtatacatgtgtacatatatacatacatgtgtacatatatatgtatgcatatatacatatgtgtacatatacatgtatgcatatatacatatatgtgtacatatatatgtatgcatgtatacatatatgtgtatatgtatacatgtatacatatatgtatatatgtgtatacatgtatgcatatatgtatatatgtgtatacatgcatacacatatgcatacatatatgtatatatgtatacatatacacacatgtatatatgtatacatatacacacatgtatatatgtatacatatacacacatgtatatatgtatacatatacacacatgtatatatgtatacatatacacacatgtatatatgtatacatgtatacacatatgtatatatgtatacatgtatacacatatgtatatatgtatacatgtatacacatatgtatatatgtgtatatgtgtatatgtgtatatatgtatacatctatgtatatatgtgtgtatatatgtatatatgtatacatatatgtatacatctatgtatacatatgtgtatatatgtatatatgtatatatgtatacatatatgtatatgtgtgtatatatgtatatatgtatacatatatgtatccatatatgtgtgtgtatatatacacgtgtgtatatatgtatatatgtgtatatatatacacgcgtgtatatatatacacacacacaatttatgtgcatgaattgtgtgtttttattttgattataacttttaaaaagtcatacaagtgtattctgcatcacttgactgaccaaaatgtacacttgcataacataagtgctcaagtttgtgtttatgtttacaatgaagtcaacaacaagtagcattactttaaatgtcagggtctgataaataaagaccagaggaagctaaagaaagaacatgatactttgaacaatcctctctattaaatgggaaaattgggctttagatctgagtgttttaatttctactttaatatgcttgattatagttttaagatgaatgcataccagaaatgaattgatttatataaatctttcattttaaagcagattttatcattttacaatgtgtgagaaaagaataaaatcagacccttgattgacactgttctttcaatcagtttatgaaacattttcctctgtgtctaccacttttatttgcataattaaaaattttaatgctaaatcagaaaccaaaaatggaatgtgcataaaatccccttggactatgagtttggagagttggcattttttctggcgtgatctgctataggcttactgttacttagggcccggagaggtgggtcagggaaaacattaaatgtattcagggtatgatccatattctatttttaagttttatgctgtttattttgagggaagagatactgatatagtttggctgtgtccccacccaaatcccaccttgaattgtaataatcctcacctgtcaagggtggggccaggtggagataactgaatcatgggggcagtttcctccattctgtttttgtggtagtgagtaagtctcttgaaatctgatgattttataaatgggagttcccctgcacaagttctcttgcttgctgccctgtaagacatacccttgctctttttctgccttccaccatgattgtgaggcctcctcagccatgtggaagtgtgagtccattaaacctctttcctttataaattacccagtcttgtgtatgtctttattagcagcatgagaacagactaatacagatacaaacatgtaaagtgcagaataaggtcctatatgtcaatgggccaacttgtgtgttttgtaattaaatatactagtttagagaaaaggaagctcaagctcaacatgaactggattcatcagtggtggtctcaccgaggaacatgaccaaacttcagtataaattgtgtttacatctcttcttaaaaaaataattaaatacatgttattattgtttgaaaagttatttaatactgagcatctacacattaatcatgatgaaaaaataatattaaacttttgtatgtcctgctagcttaggaagaatgacactgacaattatttcccttaaccattgtggtaagccaagtattagttcatagcaaatatttcatttgtagatttcagtttttttcactatttctacttttcatacaatatcattcttcaaatgataaaatagtacttagtgaaggatttgggagcatgttaaagttatttagcattaattgcagcattacactgggacacatgtacttctatttctgtaacatatcactcatcatttcactcagataaaggaaatattaaacattttatcagatggggaattcctggggtcacactgtagcagatgagttgggattggtataccttctccaagcttcctattagttacacacgcacacacacacacacatgcacgcacacacacacacactccagtttggaatctgtctagccaagaccacagtgcaagatgttaaaagcactccacttgctttgggcatatgccaggcctgaatgagtctcttaccattgggaaaacgatctatatttaaatttttctagatactatctattaaaattattctatattaccaaagaatggaaatattttccggaaagttcagagtagcaacatattccttaagcatgtttccacttcaaaagataaaaagtttagaagacatctccatgtcctcaaaaagaagtaagaaaacattataattattgattaaaagctgggagccctagaaagaaaccttggagatgaatgacaaggatacaaaaggatttgtcaaaatgagaaaagaagacaaggaaactcaagtacagctagcgatataaaagctgcattgaagtctattatagtcttatatgacagaaaaaggtgaagaaaattgtatataagtaaggaagaaatgtttatagatgaaaaattatatatatataaaatctatagattatatataatatatacaggaagagagagagagagggatggaggcagggagggagggagagaaatagagaatgagaatgtgatgaagggcagagaatagggatcagaaatacagctgattcagttgaaggaaccagaaaatgggagggggcaatatatttgaataaaataattacaaatatgtaataaggataaaaacataagtctttttctgttgctcttgctctatgtacatgtgagcacacgggcacacgtgcgtgcacgcgtgcacacacacacacttagaaagttgaaggctttgtagttaagtagggaatttgtagtatgtagggaatttcaaccttgattcagagtgacaggcaaagatttcaaatggaggtatatgtgtattcttcaatgggaggataaattgaaaacataagtaaggcataaaatgtatctaaaaaattttaaccttactaaattccaatgaaatccaattatgattttcttcctaaacttgacaaagttattcctaagtgcatctgaaaaatatagcaaagaatatgattataattttaaagtaatataggaggacttgccataccagataatattgtcatgggtcaatcatagtctttaaaacaatatagtactaacttcaggtgagcagacaagccaagggacataacagatggccctgaaattgactttatcatataaaaagactagtatttaattttttaaagtatcattaaccagtagggaaataaccatctaaagaatatatatctattagccatttacatatataaccaattaaatatataggtttgactatgtgtctccactcaaatttcatgaggagtcgtaatctccagtgttggaggtggggactggtgggaggtgattggatcgtgggggtggagttctcacaagatctggttgtttacaagtgtgtggcacctcctcctgcacttactcttcctcctgctctgaccatgtaagatgtgcctgcttcccctttgccttctgccatgatagaaagtttcctgaggcctccccagaagcagtcatgcatactgtatagccttcaggaccgtgagccaattaaacctctttactttataaattacccagtctccggtatttatagcagtgcaagaatggcctaatacaatatgtaactatttaaatatatacaaaatcattcaaatatgtatagaaccatttaaatacatatattaaattatatatatataatttttcaatttcacgtaatctagagagtttatattaaaattgaaacatgacaaatgagaaagctattggttaataaatctctagataaagcagaacttttcaagaatttttatttaaaaatgaaagggaaacactgggcatggtggctcacgcctgtaatcccagcactttgggaggctgagacgggcaaatcacctgaggtcaggagattgaaaccagcctggtgaacatggtaaaaccccgtctctcctaaaaaagtaaaaattagccgggcatggtggcatgcacctgtaatcccagctacttggaaagctgaggcagaagagcctcttgaacccgggaggtggaggttgcaatgagccaagattgcgccactgcactccagcctgggcgacagagcaagactctgtctctcaagacaaaaaaaaaaaaaaaaaaaaaaaaaaaatgaaagggaggatccttacaaaaggaaagatgattttgatgcattaaatagaaaacatttttaacaacagcaaaataaataagataaaaagattattggctaattaggtaaaataccttcaacaggtgtgatgcaatttgatttctgatacatgaattcttcaagtcagtttttataaagtagcaaagcgcatgattatgcaattaaataaataataagaacacataaaatagcaaagaaacatatgaaaacatactgaacatcatgagtaattggtaatcaaagaaatgctaaagtaataagatacaatctttcacctgataattttgtcaaaaatattaggtaaaatagtcaccctcatacactgctagtcagaataaactgtttttgcaggacagtttggtaatagctatagggaatcttaggtttaataatttgtaatcttgatctaacaactcaaattctgggagtacatccttaagaaaataattagacttttacaaagatttatataacaagaggtttatcactttgatatttatagtagcaaaaaaattaatttaccaaaatcataaacagtaaagtagttatctatgaccattcaatgaaaaactggcaacccttaaaaatatgcttaatggtaattttttttaagtaagtgaactaatcctgttttttggatttggattgtcttttaaataaggtcttacatataatcttaatctaacacatctaaccacattgtattaaagtaaatgtttccaataataccaatgttttaaaatttatagagttgcaataaggttcagtatgtttgttattaatttccatcaccgctccatgtgtgcttggaaaggttttgtattctgaaattgttgggtacataagatcaagtttcttcattgtgtttctcaaatcttatgtatggtacttattaattttaattttttgcctgttttatctatcagtttgtaagaagagtgttgaaaagctacaactaaggtggtttatttgtatatttctcttcatattctgtcaaatattaatttatacattttaacatatatattatgttcttaagtgaatgattacattttcttggaatatatcttcagtacacctttctggtaaagtgaaactcttacaattatgtggtgactctctatctccaatactactcagtctttaaagtctatttcatgttttattaatatggttaaaccagctttgtttgtattttctatatataaatatttttatatgccagcctgtatagttttaattgaggtgtgcctcttataaatccatttaactggatttgatatttgctttgttcctgtatgacagtctttgcttttcaactggaacttttagttaatttttaattgtaatgactagtgtctgtaatcatgcctaccatattctgctcctgcttttttttttttctttttttttggggggtggggggatacagtttctctcttgtcacccaggctggagtgcaatgttgaaatctcagctcactgcaacctctgcctcccgggttcaagcgattctccagccttgcctcctgagtaactgggattacaggcgctcgccaccatgccaagctaattttttgcatttttttttttttttagtggagacggggtttcaccatgttagccaggatggtctcgatctcctgacctcatgatccgccctcagcctcccaaagtgctgggattacaggcgtgagccaccgtgcccggccgagtttgaacgtttttatacttgatctctattcttttcatgatcctgcagaaaatttgcacatatgcttaacttacgaaatctacttttagctatatctttactcgccttcagaacaatgtaagtacgtaggagactttattcctgtttctctgtattttagtcatctttttttttctaattcacaaacgggacgttatcatcatttctttatgcagtcaatatttgtttaatgtaagccccatgaaggcaagaagtttttattgtggtggttgttcaatgttatactccaaacacataaaacagatcctacacatagttattatgcctagataattattaaataggttgattaaatatacccaagtcgttaacttttttttttttttttgctcatcataccttcctgcatccctctgtgttagttttccttctgcctaaaaagtaattgtttataatttccttcagtaagggtgtgttggtaccaaatactctctgtttatttgttgcctgaaatgttcatattttgctttcattcttgaataatactttgatggttatttagttctaaatttttttaagcagagtgtagtattattccacagatctttacattcattgctgcctgtaagaatttggttgttagttttattgttatgctcttgaaggtactctgtcttttctctcttattttaaaagttttctctttgtgtttaattacatatgatttcactatacatacatagcagcacatttccttttatgtattatttatttatttatttttattttattttatttcattttgagacagtgtctccctctgtcacccaggctggagtgcagtggggagatctcagctcactgcaccctccacctcccaggttcaagcaattctctgcctcagcctcccgagtagctgggattacaggtgtccaccaccacgcctggttaattttttgtatttttagtagagacggggtttcaccatgttggccaggctggtctcgaactcctgacctcgtgatccatcacctcggcctcccaaagtgctgggattacaggggtgagccaccgtacccagcccacatttccttttatttatcctttttcagattcattagtgttcatgaatctggaaatgtctttcactagttctggaaaattcttgcctattattgtttccaatattatgtcagcctcattctctttctcctcttctcatggaattccacttagaaataagatatattttcttattctatcctccatatctccaaccctagtctatattttccttctctttgatttgttcctgcattgtggaccatatctttagatcactgattgtttcttaggtgtttctaatcagctgttaaaatagccatttgttcttatattcaataattatatttttctttctaagacttatagagttttttatttccaagtctgcttaacaattttacatagtcttttgtttcttagtcacataataaaccccttcttttacttcttaaaaataaaaggtacttttaaaacatgcttactttataattaatttcgaatgatttaaatatcccaagactttgttagaatctgctgtctatattctctacttgttcccactcctgcttgtttgcttccttccttccctcctttctcctttctctctttctttgtagtatgctgcacagttaggaaatacagtctaacgtatagtgacaaaagaggggggtcagtgattctcctgttatatgaggtatggggtaagaggaacagagagaagtagaaagaagggtggatatattagcagagttctctagagggacagaactaataggatagatgtaaatatataaaggggagtttattaagtaatattaactcacacaatcacagggtcccacagtaggctatctgcaagctgaggaacaaggaagccagtagaacttggagttcaatgttcgagggcaggaagcatccagcacaggagaaggatgtgggctgggagactaagtcagtctagccttttcacgttttttttttttttctgcctgctttatatttgctggcagctgattagattgtgcccaccggtattaagagtgggtctgccttccctagcccactgactcaaatgttaatctcctttgacaacaccctcacagacacactcaggatcaatatcgcatccttcagtccaatcaagttgacactcagtattaaccatcacaatgggattaccaaagagcacaagaaaacttttggaggtgatgtgcatgtttctgatcttgattatgatgatggtttaacagctgtatacctatttgaaaacttaccaaattatacactttatgcagttaattgtatgttaattatacctcaataaacttgtttttcaaacattggacacatagataaccaaaatctttataattgttagtcttctacatggaaaattcatttataatttcactttcattttttcacttttctgcatgttggtaaaagcacaccctttaacacaggaatttcatttttcagaatctattctcaccaagtcaccagatgaacaatagatcatctacacagttataaatgacaatattgataagaaaaatgtgataagaagaaacgcttagaagcaacttaaatgttgtacagtaaaagtttgatagacagattgtgaaatatatatgctagaatataaaacagtcaacattatctggagaggactttatgatttaaaatgtttcagtcaacaaaatagcacaaaacttttagttgtttacactgtggtaataatttcataaagattcgaagagaatgaaataaggtaagccaaatgattaatgactgttactttggaaaagtagagttgtggataatttttatttccttttttatgcttttcttcatactccaaattctctaccatgaatatgcattacttttctcatcacatttttttgaaaatgactaaaaggaactctcccaaataattttccttttatctttcaacgaaatggcttttaaaagaatcctctcatagaggatttgaagcacgtcaagaaaattgttcagaacggctgagagtcttatggtgaatgtgacaaggttatagtccaagttttgacatgttcatcattaacgttctgctggtccctagcctgtctcagtggatggagatgaattcattagagatgagtaaataaaaaagtgattttctctctaaattaatataacgacacacttttatgatgaattttctaaatcatttcaggttataccttcctctctgtgagttcaattatctttgtcataaaaagcttcttttccatagacaagctttacccatttttcatagcctaatttaactgtaaagctgttaacatcctaatttaagctgatgataaatagtcttttaaccgatttgaaatttttgaaattaggtggtataatattcatagatataaccttaccaattgtgaggtgaaaaaaaattcaaagcataaatatggctttaaccttgaaacctgacaggcgtttgaataggaaagagatgagccatttcctgtatttaaatttctctagactccccgtgccctgtgtgccaccattttgattaatccttcttaaaacttatcttctattaaatgtgtgaaaaacatatgtttctcattgttaacatctcaatgttttactcaagaattggataatctgaggaagtttcattaataaaggaaaatatatatccgggaaatattatgtatgtatgtatgtatttcacacctttctctttgtaggttatcaaaatagtgtgaaaaattagaattaggcttagaacaacactatcttttactctaaagctctctagaaaaggtccctaaaattaatcaaaaatgggcactatgtcttctgttttaaataaataccttaataccttacaatacctcttttacaatgatgtcatcttcttactagccaaatgccaagattctgatgtaagagagtaaataacttgtgaaacaaagtaagagaatctaaaaaaaaatcagtttgcttggggctttatttgtatcattattttctagcattttaccaattcatttgtgtttcaatcatccatgatgcattttcttaatgctggctgctttcattttttattttttaatttttaaaataatttcaacttttattttagatttgggggtacatgtgcagatgtgttacatgggaatactgcatgatgctgaggtttggggtatgattgaacccatcacccaggtagtgagcatagtacccaatacgtagtttttcagactttaccccccttcccccgccctgcatctggtaatctgcagtgtctgttgctctcatatttatatctatatgtactcaatttttagctcccaattataagtgagatcatgcagtatttggttttctgttcctgtattaattttcttaggataatggcctccagctacatgcatgttgcttcaaagaatgattttgttcttatttatggctgtgtagtattccatggtgtgtatgcaccacattttctttatccaatccacccattgatgggaagctaggttgattccatgtctttaccattgttaatagtcctgtgatgaacatacaagtgcaggagtctttttggtagaatgatttattttcctttgggcatatacccagtaatgagatttctgggttgaatggtagttctgtcttaagttatttgacaaatcaccaaactgctttccacattacctgacctaatttactttcccacaaacagtatataagcattcccttgtctctgtagccttaccttttgttttttgactttttaataaagccaatctgactggtgtgaagtggtacctccttgtggttttgatttgcatttctctgatgactagtgttgtgatgcattttttcctgtttcttggctgcacatacgtcttcttttgagagtgtctgttcttatcttttgcccgtttttaatggggtaatatgttttgtgtctattcaattgtttaagttccttatagattctggatattaggcctttgtcagatgcatagtttgcagatattttttcccattctgtaggttgtctgagtactctgttgatagtttcttatgctgtgcaggagcttagtttgattagatcccacttgtcaatttttggttttgttgcaattgctttagaggacttagccaaaaattctttgccaaggccaacgttgaaaagggttatttcctaggttttcttctgggactctaatggtttgagaacttacatttaaatatttaatcctttttcagttaatttttctatatggtgaaaagtagggatccagtttcattcttctgtgtatggatggccagttattccaacaccatttattgaatagggaggcctttcctcattgtttaattttgtcgactttgttgaagatcagatggttgtagggtgtgtggctttatttctgggttatccattctgttccattggtctatgtgtctgttctcgtaccagtactgtgccatttttgttattgtagccttatagtttaaagttgggtaatgtgatacctccagctttgttctttttgcttagaaccgctttggctatttgggctcatttttggttctgtataaattttagaatagtttttttttcctaatcctgtgaaaaatgatgttgatagtttggcaggaataacgctgaatctataaattgctttgggcagtacaaccattttaacagtattgattcttccaatccatgatcatgaaatgtttttccatgtgtttgtgtgatttatgatgtatttcagcagtgttttgtagttgtccttgtagagatctttcatccccttggttaggtgtattcctacatattttatttttgtatgactattgtaaatgggattgcattcttgatatggctctcagcttgaatgctattggtatatagaagtgctattaatttttatatattgattttgtatcctgaaactttaatgaaatcatttatcagttctaaaaggtttttgatagagtctctagggttttctgggtatagaattgtattattggtgaagagagataatgtgacttcttgtttttctatttggatgcctcttatttctttctcttgcctgattgttctggctgagaattcagtattatgttgaataagggtggtgagagtgggcattcttgtcttgttcctgttcttaggatatatgcttccagcttttgcctgttaagtatggtgttggctgtgggtttgtcatagatggctcttatttttagttatgttccctagatgcctagtttgttgaggctttttataattttataaaatccctttgtataagggatgttgggtttcagcaaaagccttttctgtgtctattgaaatgatcatatagtttttgtttttaattttgtttatgtggcaaattgcattgattgatttgtgtatgttgaaccaagcttgcattccagaaataaagcctactaaatacctatatcaagaggttatacaaatctcaaattaatgatctaacatcacacctagagggactagaaaaacaaaaacagtctaaccccaaaggtagcagaagaaaagaaataattaaaatcatagcagaagtgaacaagatagggaatcaaaaattcatacaaaagatcaacaaaatgaaagatgattgtctgaacggataaacaagataaatagactactagttagatcaacaaagaaaaacagagagaagatccaagtaagcccaatcagatattacaaaggtgacattataacaaatcccacagaaatacaaaagatcctcagagactattatgaacacctctatgcacagaaactagaaaatctagaggaaatgcataaattcctggaaacacacaatctcccaagattgaaccaggaagaaatgaaaaccctaaacagagtaatattgagttctgaattgaagcagtaataaaaaacctaccaatgaaaaaaagccctgggccaaatggatttgcagccaaattctaccagaagtacaaagaagagctgctaccatttctactgaaactattccaaaaaaaaaaattgaggagtagggactctccctaactcattctatgaaaccagcataattctgacaccagaatctggtgaagacacaacaaaaaaagaagactataggccaatatctctgatgaacatagatgcaaaaatccaagaaaatacaagcaaactgaatccagcagcacatcaaaaagttaattctccatgaccactctttaaaaatgatatttaatgtgcctcattttccttcctccccccccactgaaatttgcttctatttcatcattcctgttgcatctaacactgagcaagtatcttaggaaacaatacaattttgtaaaagatgttctgcagtagcctctatgtaaatatcgtttatccctctgtcttattaccaagataatggatgtgctttttagctctctctgttatatatatcctctactttatgtgtgtgtatatatatatatatatatctcctctgctctctctcctttagctctaggtttcaatattcattcccaatatagcaggcaaacttttactttgagaaacttaaaactctaatcagacatttcaattcctacatgccatctcaagcctaatttgggaactgtgggagcataataacgcattgtctatttcttcctttctacttttgtacaatagcttttgacttggagggagtttacttctacttgctgcacaattatcccaacatccagctcaatttcaaaggtccatttagctgctttggtggtacactttgacagcctattggccttgtagattttaatgcattttgcattatttatctcagttttccaagtatagtttttctgttgaatttctactcgttaaccaattttctggaaatgtttcccaattgatctgcattgcacctgtagcttattttttttttggttttggcaaaactcagctgaaaggtgtatgaagtacaatgtgatttcttagcacattgatggtactaagttggctctaaatgtgctgatgcatatagtacacttctgcaatgatgtctctctgggaaaccccatttaacttgagttacaataagcaaagataacagcaaagctctcagtactctttgagacaaaggtctcatacaattcattaaaattaagatgattctggctgcaagttatagaaacccagattccgattgattaaaataagaagggatgaatggtctcacttgacaggaagttcagatatgggatgggcttcaaggaatgctcatttagcaatgtcatcaagggtccaggtgtttttctcttcctctgctctgtaattcttagtatcattctatgtgtggtagaaagatggcttacagcagtcccaggcatcatatctatatccaggagacaaaggtaacctattttttcttatgaatatctcatatgagcaaggagatgtccctgtagtccaagatgacttcttattacgctttataggtcaaagtagtgtcacacgctggttctagagtaaaccatgagcaatattcctcttaaaatgatcaggccctccataaaagtgggatgagttctgtttttactgggacatatggatatctggacttgggaggatatctgatcaaaattggagttctaatagtacaataaaagtaaagaaatgaatgttggttgggaaacaatgtccaggttgtgtcatcatcattgaacagtggaaaaaaatgcagagggcagtgagagcccctgtggcccactggctgtgaccagcatgggtttctaaagcactggtgaaggataaaagaagaggacaataagaatgcctatattttggcccgaggcgaaaataatgaatagaattccttagtgggcagatactgtagtttggcccactcaacacccctttcatccctcttctatagagattggaaaggaaagtttttgatttcacagcctctcttgcagcttggcttaatcaaaagcagaatgctggccaatgagatttaggaaaaatttatcaggctgcatttgctgaataaatgtcaaatttgtatttggaagcacgatatctttcttgaaataaggaagataagaagtcacttattaaggacgttggagtaggaagtaagctgtgctctcagtggcatcactgagatgccatttgagtcttggactatatactctcaaaggtctggtcatgtgagaagacgtaaactatagcagtagctgaaagcaatgctatcaaatatagagtgctcaagttagttacataagtttactcatataatattccaattaacttagccttttaattgtttcccaaaggccaaatcagaaaaacttctcaaacagtatatatcacaaatatcttaactagtgcgaacccagaatccacctaatcacactcccagtgccttagcagagacaaccgtggctaattcttcaaggcgtcatttatatggataaatgttacatccacaactcatatctgaaccaaggcaggtttcataaatcagaagtctagtttgagcccccacgtcagccttattataacattcaacgtaacaaaggacggtgtgttataccttatgtaaactgacctttaaattggcctgaaaatattcacatgcatgaatggggctgtattacagcaatgacattgaaaattatattaaagacactttatttagcagcaaatttaatataacatttgaactgctaaaagtcaagtaggaagtagagagtactttcttcatttatttgatgaaaaaaaagcacagactgctttaaaaatataacttttgactacatacaaccagatgaaaaaagacgttaactagagggaaatttgtttcatacccataaatagaaactaacttaaaatgtaccatggtgggggggaaattagttgagaattacaaaatcctcaactgctttaataccacagcttcattccatttgcctctcaactattcctgctggggcttctgctatagtttattaacaagtatcagtgtttccattaccttagaaaaacaaaaccaacaatcatttttcaaaagacattcaaattgtcagtatgtaattattgctaatattaagaattcagtatgttaccacatacaacgcacataccaactatctactcattgagataaacttatatttccgaaatgaaaaaaaagccattataattaagactcaagaaaacttttccagtataaatatactcttaattaaagttgagataaagatatatctgtgagatagtttaccaaaatatttatgttaaacatcaggctctactatatttaagagtgggtttccatcaaaatacctcataattatctagttgcctgcatgtacaacagaaatacaagaactgaactggatgagtacaaaagggctttcaaatgtgtccactaatacagttaaaagaatataagctgctacatgtataaatacaatattatataagtatattatataaacattattttcattttatcttctaacagctttataatctaagtgttatataagtattttatatttatatgatatatacttataaatatatatcaacacttatataaatttatatatacttatataaatatagtataagctactacatgtataatatactgcatgtataaatataatataaaccatatacatggtatacagtttattctcctaagtaacaccaaccattaactttgtagtatatcatatgaaagagatgatatggttaggattcaataatatacagaggtatttgtcactaatagatgtagtcaaaaatcaaagacaataatgctaacattttttatattactgtttttagcagtggaatattttctttaagccacaggttacaaggcagtccaatgtagaacaaagataaaaacagctgcgggttgaagcagagctgactattcagccatggggagcttctcagaaacattagaatcctttatagggtctcaaagagacttgggacctaagtgttttctcctatgtcctaataattatacctattttagcccccctctggggacattttaagtgaccaagaattgttaagaggaaaatgggaaggattctgagctccaaactacatttcatgctggccctcccatcctcctaggacatctgattatttgtataaaggagatgtattagaagtccttggaattttctaattagaagttccagctctgattacttggagtttgagtaatttttcaagtaagtattagagtcaaggcttggacccagatatgactataaaactcatacttttaactaatttttatgtagttttccactgatacactagtggcattctcagccaactaattaagttttctctgctgaatgttttgaattctttgtcttgggtaatctctccctttaaaatgtaaggttgaacctgtagagctccatattgtcacttaattatgacaacatagatgagaaaagtacaaagctttgatgtgtctttggtggagattatatgacatattgaagttttgtgagatggctcagaaagttcagtaatagctgacgttgaaaagaatcaactcttatttatgcaggtgaataataatgtgactaatctggtattgcccattagtaattgatcatttctctctgacttgggaactatcgcctgtaatcccagcattttgggaggccgaggcaggcggatcacgaggtcaggagattgagactaccctggctaacatggtgaaaccccgtctctactaaaaaatacaaaaaattagccgggtgtggtggtgggcacctgtagtcccagctactcgggaggctgaggcaggagaatggcgtgaccccaggaggtggagcttgcagtgagccaagatcacaccactgccctccagcctgggtgacagagcgagactctgtctcaaaaataaaaaataaaataaaaataaaataaaacaacaacaacaaaaaggaaacagattttgaagttacatccttactgaaaactttgttttattttcttcaggtcacttacaagaaaccacttactcataatgaatttcaattatggcatgacctatgtcattatcctgggatttaagggtctagatttaggctgtttttattcacatggctagaactgtatctatttagaaaattaatttaactttaatgtatcaagactattttatatagcattgatgattttctacttcaaaagggaaagctttaagatccaaagacattgatttccaaactgggacaggcataatcctgaaccttaatcattttattcttagtgcttcagctttctattgaattttagtgaaagataacatggctctggacaaactttcgtctcttggagagagcaagttgacacagatctgaagtattttgtacatttgttgaatatgccacccagtcttccacaatgtgggagtgcaacatttaagtatcaaaatgaagcgaagttatcttggtgaccttctgacttctagcttataaaccattcatatggaagccagaaaatacagtcaaagatttaattttccaattgatcttgtatttagcatcatttagaataacaatctggatacttaatctagttttttttttaaatttcaatcagtttgtttgaaatcatgtaaacaaacaaagcctatattgtgaagaaaatacatttaattattaccgcctctaaataaatctagtttaaaacacatgtggtgaatatttgcagaaaagtgcatttaacaagtatgtggcattgtaatattaaagaactaatggaactaacggtgaagatttactaggcataaattatagaagcagataatgaggttattaaaataatatgtatctgtaatttttatataaaagactttaaacatttttttgaacttcttttttgtgtgtttacagatatacactttttttttttgcatgttttggtctacataggcagcatttagatatgctgaaggtagtctagtaaagtcttctgcctgagtaggatattttattaatttaaattacagtataatgttttaaataagaatgtatgtttttgtaagtgagatgggccactcactcatggaatcgacatatatttgttcagtaccaacaggatgctgacatggtgccagacagtgagaaggcaaggattgggttttattcaacgtggcagcctctatagtgtttaaaacattgctttaaaagctgttggtattctgtaaatacttgttgaaataatgaaaaaagaaaggtcctcgactttggagaattaaatatgcaggtaataacaatgtgatactacagtagaaggatggttcctatatttatatagctcagaagaacttatagtggaaggaatggaaagtttccacagaggagaaagatgaggaatttgatatgataataggaaatggtgtggccaaaggcacagcttcagaaaagaataaagtagccatatgtgaagaataaagtgtaaatcaatttaattggacatagtctccaatgtaaaggaaataaacttgggaagattgtgcatgttcttgaatgtggactagggaagtttgatctttgtttgggaggcactggaggcttttgggcatatgcatgataagattaaaggtccttcctgaagattaatctagccgcagtgtgtaagatgggttgtcacaatgggagataaaaatggggaaatccactatgagatgaatttaattggtcacatggaaggtaataaataatagcctgagcagccagatagtgttcctgtatttgagactgacctcgtttttccaagatgcttcaaactgtgagatatttccagaagtctcaagtgtgaaataatcagtgttactctaaaataacattatgcaaagctacctcacttttctggaaatcaggcatccaaaagtgttaaaacactggaacacagatacaaatctgaacttcttgttgagaagactagactattcactttgcggaaactgaaagcatgtatatcttgtttttgtttcattgccagcaccagtgccttgaagagtgaaaactgaagttaggcaattcatgtataagactttctataaaataattagtttctaaagggtcaattcttagaagtacattttagctttctgaaagacatatttccagggtagaactaattcttaaataatgatgaatattgaggtgtcataatttcatatttatggaaacattgtctctccttgtgtataacttaacatgtaatttgagatttaaaaatgaaggaatttgatttcatttgctgttatttaagctccctatgtctgtttaaattttgctctgaagaacagctgctctaaagtacagccaatatttcttcctttgggatagctagttccactgaaaattttgatatcgtcaaaatgtgctgtatgtgtgtctatgtgtagccaatctccctttctcacatccccggatacccatgtccttatgcctgccactggttctcaaactttaaagtacataaatatcaccagaaacaattatttaaactatatgttcctagccctacagtccctggagattcagattccataggcatggggaagcctgagactgttttgataagctccactaggcaattctaatgcatgacttccagagatcataccttaagtggctgtaacttaagctctctctgccttacttgcatcagatgtcatgttcctgactttaagtagcagttattatttaatttaattaatgaataaagtcaaacaatgtggatgtctagaaaatctcctctactgaaagagcctgaaatagggtgtgttgccttactagagtctgatcggtagtagcgtcatcccacattgagagctgcagtttcatgctctcaatcctgagatgttttacagcagggtaaatgatctaatttatagtatgtgctgagatatttctaaagaaagcttgtgtccgagggtagaatgttttatgtgtttaattacacttgagttccaatccaattcgaagccatgtctacaaaggctggcgtttagtcagctaaacatttgaaagcttctttgttcctaagggggaaagcacaagactaatttttctaacaagtaattgcaggtgcaagttatgtttgcaatcttaaaaaaggaagtgtctcagtgaaggggaaattaaatgagagggttaaacgcatgacctagaaaggatgtttgaatcacttgtgtttttccatcttgtacaaaaatccatctttcctatgagatagggctaatttaccagttgtgttccttttaatatgaggaagttgggggctggagggagaaaaaggtaggaagaaattagccaaacacaatcaccagaacatgttttttttttttttaagccaggagggagaaggtgaagatctacacaataaaggagtaaataaaaacacttgtaggggaaaaaaaataatggagtgttttctcatccactaaaacagtaaaattccatctttaggtttttctttgttcagttctctttggaaggaactttctcagctgaaattttatttgctgtttttgtgtcatttttgtcatcagaaaatatttccaagttaagcaatcttacaaagaagtatctcaggactatcaacattagtgagccgggtaccctgaagtgaggtactctttcctcacttcatagtgtggccaccatagccattcttgcctttcttcagtttgctgtctatcggtgtccatcagaaataccttgttggcaaaaatgtcttccctgcccatcttatttggtctattaatgatttcataaacttcaatatgaatctttatgagacctcctactccaaactggaagctctaatcccttttgcctctcctcctttggcaaccagttcctctctttgatgtccctagtttcctttctctagatttcttccagttccatcatgctttccagatatatctccaccaaaaccacctccaaaaagctaaattcttattggctgccgcagctcaacagcggatgctctggtgaaataagcataacaacaatagttgctttgtatgtagcagggatcagcacagttttcctgtaaagaactggataataagtagtttaggctttgtggaccatgtggttttgatcacaactattcaatggtaccagacaatacttaagcaaatatatgtgtaacttattcaaataaaacttttctttgtagaccttagaatcatttcatataattttcacatgccataaactattatccttcttaagattttaaaaatcattttaaaatctaaaaataatttttgtctcacaagctgtacagaaacaaaacaggccagatttggactgctgaatgtagttcgccgactcgggttgagagttttttgttttcacggtgtccctacctatcatctcatctaattctcccccacagtcttgtgagaaagttaataccgctgccattttataaatgtggaagttgagacttggaaaatgtgactgtcttgcccaaagaaagagaactaataacctgtgtttctggaacctaatcctacattgtcatgcgtccaatcctgtgttcttacctccataacacacttcatgctagtgttatatctatgcctgactgacacagttcaaatctccaaaccaaccaaattccattgaggtggccatttctataaaagctgtcctttggaaaaaaaatttatccaaaacatcaggactcaagagtgtaacagaaggagggcttgttaaaccatcagctgctggacataaccccaagaatttctaattcagtggttttggggtgggggccaaaaatttgcttttcattttttaaagttagataaaattcacacaccataaagtttactatttaaagtgttcaattatttatagagttgtgcaagcatcatccattattatctaattccagaacatttgtatcgccacacaaggaaaccctgtacctatttgtggtcacttcctattctcccctccccacctccagcccctggcaaccactgattgactttttatgtctatagatttgactaccctgaacacttcatagaaaaggtatcgtacatgtggttttttgtgtctagcttccttcacttagcataaggttttcaagattattctcattttagtatgcatcagtacctcattcctttttatggatgactaatgttccattgtatggatatactacattttgtttattcattcattaattgatgaatatttgtgttatttcagtggtttggtttttgtgaataatgtctccatgaacatgttttcaattcctttggctatctacctaggagtgaagttgctgagtcatacggtatctctatgttcaactttttgaggaactgccaaactgttttccaaaaccagctgcattatcttacattcccatcaacactgtatgagttccaatttttccacattctcgtcaacacttgttattgtctgtctttttgactactgtcattctagtgggtatggaatagcaactcactgtggttttgattcgcatgtccttaatgactactgatgttgaacgtagttttgcgggttggttgagaatctgtatttgtaacaagctcccaggagatgctgatgctacttgttcctggaccacactttgagaaccactgatctaaaaattaccacttactcctagcaaatagaatatgctgtgtataattgtttttgtaatcatagtcattatggagctgtactttagacattgaatataaaggaagaacttattccacaagatttatcgagaacctgaaaagtgcaaggcactgttataggcatcaggaaataaattttttaacaacagatacaaagtgagagtttacattcaggtgcgtgaagatagacaatagatgataagtgagcacctaacctttcaagtggtgatacatgctatgaacaaaaatgagagagggtgtggctctagagaggggacagtggggaaaggtaaggtgaccagagaaggcctctctgatgaggtgttgtttgatcagggatttggaggcagtgagaaagcaagacctgcagatttaatgcacaagaaggtaaaagcacagtctttgggaccaggccaagctcaatacttagggctggccctccactcgtcctttgacctaaaacaaattacttaaccactctgtgtctcagattcctaatctattcaatgggaataatagtatttccctcataggattgttatgaagattaaatgaggtagtatatgtaaagcatttagagagatgtgtggcacatagtgttacataagacgcggatatatatgaggctaagaaagctaaaactttagtccctctcacttacatgggcctcttctgtggccttctattaaatattgtatacaaagtaccatattcttttctagaaagagagcctccaagttgtctaagctgtaggccctacatagcctagacctgtacctgatattaactgctatttattcatctctgggataaatgattccagacaaagggagcaggagtgtaaaggcccaaaggctgggagaacatcaggaagacattgtaactggacaaaagtcagggaggcacaaagggagaggataaggtgagaccaaaagggacagtacttgggggatgggaatcgtaggcatagagcaggtcttggtaaaatactttgtaattgtgaattagattaggagacactggagagttctgagaagagagtcatgaactgctttgcattttaataggatcattttggctgacctttagagactagatgattaagaaggcaaaattagaaggtggaaaactcatggagaagcagtaatctacagatgagataatggtaccaaggactaaggtagagatggtacgatattgatagtttatgtatatattttgataatggaacagacagaacttgttgatgaatcatatgtgggattgagagaactgttaaggatgattgaaagatttggtgtctgaggaactgacaagtgaggatcaggactggatgtacatgtgcagtggaaattaagagtttgatgttgaacatgttagttttgagatgcctattttatctgtaagattctattttatttctatgatatatagccctgatggacattttttggaatctctacagttagactattttatagttatatgcccatcataaaattctatgcagaatgtaccatatggacttttggtgctataacacagatgacttttatggaaaatcagacaaggtaggtcagagaatttctttatggccagctccaagacaggaaggtggggagagattagagtcctgccggggggaaaaaaagaggaggtgaaaagagggtacgagaaggtcagaaggagagattttttctgaagtctgcttctgaggcctgcagcaccccaacattataaccaaagatggtcttttatctttattgctctgaagcacttccaaagctgcttcaggaaccaagggcaaatggccaaatattttaacaaaaggtatgcttattgttttaaacacttaggaaatgacaagagttatgagccaggaaccatggacaaaaacctacacacacacacacacacacacacacacacacacacacacacacacacacacacacaatgttattacaccctccatggaactatgatggttctgtcctttttatgttacatgacatggaaggtttccatttaaactgtattatctaactagtagataatgctagcaatattagtaaaattattgtgttctctgactgtaaggacttgaggacatgtttcctcatcttcataaactactgcctgcccctatgcttgactatggtaggtgctaaagatgttacatgaatgaaagttacaataatctgtacaagaatgaggtctttcttttgggtattttatttttgtttagaagggatcttatactcattaggcactgactatccataacagcttaatactggacagtgtagtcaaaacacatgactacaagttccaagtccaccaatttttggctttattaatttgacaagtcactaattatctgagcattacttataaaatggaattagtggtattttttctattttacagtgttatacttaggattggataagataatatacagaaaaacatgatctacaaagtaccaaaaattatattaatattttgatctaatctagaaaaattttgattgatagtgtctactgcttaatctgagaataacataccttgctatagtttccaaacacttttcatagaggatgtaaaatggattttcaaaaattacatttcctcaatataaattacaatggtttgatcacttaacatcaactctcattaaaatatgattctctttgtaggctgaattagctctcttttgagattcatatgtagaaaataaccaagtataaaaaggcttgctgcaaatgtcctctgatatttgattttgagtttgacatttcaattcaattattctgaatttaaggtgtcttaaatcattgaatacattttgcggataatatgtccctgtacccttgcatatttttcataacctcttatacattagccaaaattagaaaaagaaataatcctcttccctgccttaagctaaactagaatagttggcacatttaaacaacaaatgatgagaaaaaaatgacattgataaaagtttcactgagtcatcatgaatctcattgggtgagcaattctattgagggagcatatatgaattttcatatactttaacactttaattgtgctaatattttaagtaatatttgttctttaaatatattttcttatttttctgtcatttaccaagtatagattcatcatttaccaattctgactcttttttttttttttttgagacaagagtttcattcttgttgcccaggctggagtgcaatggggcaatctcagctcactgcaacctccgcctcctgggttcaagcgattctcctgcctcagcctcccaagtagctgggattacaggcacccgccaccacgcctggctgatttttttgtatttgttagtacagacggggtttcaccatgttggccagccttgtctcgaactcctggcctcaagtgatccacccatctcggcctcccaaagtgctgggattataggtgtgagccaccgtgcccggcctctcagactctttaaaaaagatagctgaatgggactgaaccaaccagtgcagatccccaagggcaaaatttgggagtaccttgtgtccatgtctctagttatatggggatagagagacaaaattgtgtttaaaggagtttcaggcctcaaggctagaaaaattggcttatccaaataggttctcaaagcaacatgaaatgagatttaggagatgcgttttggaaatggccctaagagctaggaaagaatggagtaaagtataatggttccaaatttgaatttaaaaggaaaattagagacaatgtctctagagactagggactctgtcttgttcacagctgtattctctgtgaatagtgcttagaacataaatatttcttggctggcaaaacaccgtttaccaattgtgtttattacatgcttctgctaaggtattgtgtgagcaaaccagacacaatgaaagggctcaggaaagaaagaacaagatcctggtatcaaaaacaggtatataaagtgtggctcttaccctccagtaaaaggcaattaagtccccccatggaactcagtttcaacaaatcactactcatattgtgtgggagagaaggatctcagaggatgcttataaagtgacctgaagatgagacaggaatggaatcccaggcagaagcaaagcaaaagtatgtgcaaagtcttggagctgtataaaaggatggtttgtttggaaaatctctcgcagtttaatatgaggatcatgagaaatgacactggggaaatagacatgaatcagactataagggttttcgttgttgtgctaagaaatttgggcttggttaagactaagcttcaaatagttaattctaggatattgacatgaaactatagcccagatatgttaatcatgttacaggaaagtttagcttgttagcaaaagtataatactgacctaaaagagcatacttaagtcctgaaagtggagagccttgtctaaggaggagagaaacaaatatatatagtcagaagcagtgataaaacagaaacttttcccctaccaccccaacagtatttagttaaaatatattttatatcagcctctagggccattatgtcccaatatgcatcccctctagttttattatataagtttattaataacctcttatgtatttatgattgtagttaatatacaaagagaactaaatttatggtagttcagttttaggtattgcttatatgattttttccataatgctgtcaacccgtgggacacctgatgacattctttttcaagaaccaacatcacaactaagtttgtatgtgaccttaaagtagcagaaggagctggtcatgagatgaaaagaaatgctattctacttctattagattattctcaaggactgataaatactttggattctaggtatccttggtgcaaatgatttaatgaacatgtgccatgaagaaaaataagattatagagaatgaaattaaatccgtgctctacctgacttaaaagtgtgcatattatttctctcttccaaaatatctagcatccttatataaagaaagaagtccctacataatcattcctttcccaaccatcacattcaaattatcaaatataaactctgttttcagtttggagaaagaagatatagttgctggcaaaatttgggggtgtgagtcgggaattagaggcagaaaaggcaagggatgtaacagaaaagctttatgaatatatctttctgtgccaaaggaaatggaacacatcttgcatgaaacaaaatgtgacttgttaggcagcctaagatcttatcaaaggagtggaaaatatcacccactgctgactggctagtaaaagggaattgtgctcaaatgggtcaagactcacttctcaatgtccacaagctttttttcctccttatttcctctgtaaatgctgtttttttgtttttgtttttttttttttttggcatgcaaagggacacacacacactgaacacactgacacacacaatgttatgcagagagtttcctcccagatctattcatggtttaaagccccccacctccctttacctgtaataaatatctgttggctttgatgttcactgtcagggataaaacaaattcacaaatatttggtacacgctgctcctgtatgtgacattgaacaaaatgttgatcattaataaatggtgggggaaaaactcaaagactaataaatgtcattgtttctgatgaagtagaacacaagaaggtaaatacccacaactacccccctgctaaggtacaaatatcagtaaaaaatgtgtatatttgaagtatttggtctattacaattcttcagatataaaacaagcactataagcattatggtggtgttgattttaaaattccaacttcacaaattcttccagaagtaccttatgaataaaataatgtaatattcagatgacacatatatacacatatgcacacatgcacatgcatgtatgtagtaggtatcaatagatgatagatgggtagatagatattcttctctctaccttgctgcattcaagtggctgtcatataatataaatcgtatttagtatgtatttttttttaacttggggggttctggatattttgacccacattcatatttttaaccacggtgttgaaaattctctaagtgatcttactgttccacaccttattacattaatcccctataaggcactttcccaaggagtccctgaacacttctgggagaattataggcagcccatgctactctgagcacatttaaaacatagaaacttatttacatgggcctaaatctacctctagaacacctgggtttattctacctagggctcacttcagaaatggtatgtttttcaaaaatgacaaatcatgaagtctccagtatgatttatatttcaaatccatctcttgagaaaattctggttaatagtgactgactagagtgttaggaacaattccaaggtgttttcaatctcatcaggaaaaagagctgctgtgatccattagtgatgcctgctatgggcagggtgtaggactagccaagttttgagtctatttcttctttcccataaaactcccttaaacatgtgcaaataggatccatgtttcatctaaggaatgtattctacccaaatctgaactcttttcagctacctcacaacacatgggctggcattctctgtagcctttggcatgatgtagcttgtcctatgaatatccttgtagccatcgcctccaccataaagcacagagctaatctaatctatgtttgcagtaattccatagaaaaatctttatttcaggatcacaagtgaagcttgaatacttcttaaaagttcctctgagctcatatgtatgtgcaattaagtgtactgaaagcaaaacgttatcttgtcatttgactgctaagagagcttgccataaacatcaaaaacagcttaacaatgcattcttattttttattctgcttttaaagggcattgctaaaagtcaactccatggtctggttctaccttgaagattttgtatctttctatgtctctgtggacatagttaaggatataccgatgactctagtagtgagtgcaacagcacagttgacacacacacaaaaactgcttacatttttaaaatggaaatccagtcatagaaatatcacagcacaacctctcaacgctaccccttgccaagaggctgtgaaagaaaaaggattttttttttttttttttttttggaattttgggtgatgctcttttaagagctagtgggacaaagtggaatatgttaccacttttggttctacttgagaccaaattccatgtgccctcatataatgtacttccaggatagccctgcttcaataaatagaacatcaaatattatactttgaattacaaatacatcaatgtaaaatgatttcaattttgaatatcctccattcatgctacatgactggttaagcaaaactgtgctgacatcatgacagacaattccactcacattttagttttgaatttctggtatatttatgattctagcttttcattttatatgctgggttatcttgtatcaacaatgtatataaaactgttcatgtttcctattatgacagctgcaccaagtccatgtctcagagctgtatatcaaagtggcaaacataataacacaacacagatctgttttgacactaatatggatttcatgcttatttcacatccccttggccaaacattcaaaaacattgtagttcccagtaaataacattccagaaacaaaatccagatgctgtgtctattatttcaagcacacattatcagatacaagaatgcacaatgcttttctacaatttacttttcattttgtatcctgtttttagtgctaaagcacttcattccccaaattctaaatattactgaaggtgaaataagagcctttagagggttctcttactttaaaaaaaaactgacatagaaaattacatgtatttatcatgtacaacatgatgttttgaagtatatatacaatgtagcatggttaaatcttgttgaaccattcttacatccctgggatgaatcccacttgatcatggtgagtgatcttttaattgtgctgttgaatttggtttgctagtattttgttgttgacgatttttgcacctatgtttcttgaagataattgcgtgtagttttcttttaatgtgtgttttgtctggttttgatatcaggataatggtggcatcatagaatgaacttggaagtgttccatcctcttacattttttggtatagcttgagacaaattagtattaattattctctaaatgtttggtagaattcaacagtgaacccatcaagtcctgggcttttctctgacgggagacattttactactgattcaatttcctttcttattattggtcagtttaggttttctctttcttcataattcaatcttggttatctgggaatttatccagttcttctaggctatccaacgctttggtgtataattatttataatagtctcttataatacgttgtatttctgtggtatcaattgtaatgtctccttttatctttgattttatttgagtcttctttttttttttttttttttttagttagttagtctaggtaaagggttgttgattttgcttctcttatcaaaatagccagtcttcatttcatggatcttttgtattgtattctagtctttatttatttctgctctgatctttatcattcccttccttaattttgggttgagttttttctttcttttcttctggttccttgaggtccattgttaggttgttgttctttttcaatgtcagcatttattgctaaaaacttttataactgcttttgctgtagcccatagattttggtatgttgtgttttcatttttctttttttttttttttttttctgagacggagtctcactttgtcgccaggctggagtgcagtggcatgatcttggctcaccacaacctccatctcccgggttcaagccattctcctgccccagcctcccgagtagctgggattacaggtgtgcgccaccacacccagctaatttttgtatttttagtagagactaggtttcaccatgttggccagtatggtctcgatctcctgaccttgtcatccgcccgccttggcctcccaaagtgctgggattacaggcatgagccaccgtgcctggcccgtgtttccattttaatttgtctcaagacatttttaaatttttcttttaatgtcttcattgatccatttgttatttgggagcatatggtttgatttccatgtatttttcaggtttccaaagttcctcctgttatggatttctagttttctactattgtggtcataaacgatacttcattctaatacttttaaagcaaaaatataatgattttgtcagcacattgatagatttttttttctagctttctatgtgctgggcacctatttctgcactattgtttaagttttgcaatgaccctattaggtagattatattattactccccgtcaccagtgagaaaaattgaagctcatagaggttaaataatgtggccaagattcaaaatttgtaagagtatagtcagaatttgaacccaggaagtcaggttttagtgcctattgttatcaacatatcatgctgccctgtacataaaaattataatgaaggtgggccaggtgcggtggctcatgcctgtaatcccagcactttgggaggccgaggcaggcagatcacgaggtcaggagatggagaccatcctggctaacacggtgaaaccccatctctactaaaaatacaaaaacaaaattagccaggcgtggtggcgggcacctgtagtcccagctactcaggaggctgaggtggaagaatcgcgtgaacccgggatggggagcttgcattgagccgagttcgcgccactgcactccagcctcagcgatagagactgcatctcaaaaaaaaaaaaaaatatatatatatatatatatatatatatacacacacacacacacacacatatatagacggagagaaggtgaagagttgagtaaattactaaagtttcttaagcccctagtatgtatcaggaattatgacaggcaattaacatcaataatcttacttagtcttcacaacagctttatttgttagaaaccaacattaccccattttgtaaatacaactcataaggttaagcaaacaagcaataaaattaggaaagtaagaagacattagttacacccctggtaagggaaaaagctggatataaactcctatctacttgcatctgaactagactagactttctgtatttatatcatctctattctaaaacagaacctaaccttaataaagtggttgactaaattgacttacctattttctcacttccatgatatttatgtattgaaagtacaagaagctaaaggtctttggatgaaacagaacatagcactgtgtttacaacagctttaagccacattcaaaacactttagcgtcatctcgtgttatttatttatttatattatttttgcaaattgagtggcattgttagcactttgaaaggcagaaaatatagctgcatattatatcataagaatagacaattataaaaagagtgtaagatgaagtacctttacatgagctgtaattgcagctggtaattaaactgaagtgtttcattttctcagtcagctcatcagtgacaccagaaaataaacaatttgaaagtgaaatccttaggggccaacaatagtaattaattgcattttccagggaagaagcgttcctaaagtctgtttggggtgacctcttgagtaatatacacagtgatttacactgtgagcagaagtgtggggttcagaaccaaatctgatttaacttgaatattcatgaagtctccagtatgattcatacttccatttccattgtcaagtttattgtctcctaggttaacaatgaaagcaaatttatattctgaataattcacataacacaatgagatgatcagcatggaaaaactttaccaggccagtaacacataaagtgaggctgctattaatcccttccaacttggaatctcctcaagtatcaagagcattgttttagagatacttgggagctgaaaagaaaatatttatgtgtgtaaatttggatccatatctcataagcctattggattaaaatcataacattcaggcagtctagtttgccactgttcattttcacagagaagagctttgtttgagatttgtgcacatctttttagctattctgatcacagggaacaaactgccatgacttatactctaatttctcttcttgtttttacttatgatatgaacatggcccttggactcagataggcataggtatagaatccagccccacttcttactaacaccttgtgttagttagctcataccagataacaaagaaccttaaaacttgctttaaaacactaaccctttatttagattatcattctacaggaagacaatttggggtgggctcagccaggtggttcttctggtttaggccaggctcatttggtctcagctggggctcaattatacacctgcaggtgactgccagattgggtaggtaggctgatctatggaggcttcagctggcatggcttgcctctgcttcctgtatcttccattttccagcattgcagcctgagcttttccaaatgatggtgtggcagtgatcagtaagagaaggtaaatccaaatatgcaagtctctgctattgttccattggcaaaatggccaagcccagagacagactgaagggtactgtcaagaaataatagtgatactaaaacccatgaaaaaatcgggggccattattacaacaatcaactacatatatgtataagaaactatgagccagtttcttaatccctcaggcccagttgctgctcatctcatagagttgttgtggagattaaaattaactcatatatgtaaaccaatgggtcaatcacctggcacattggagacacataataaatgttggccctcttttctctgacagatatttatgcactcccatttattggttatacaaagcaaatattctaatatgagaacaacctgttaatgatatgtcatcccactgacctctatagttattcagttatccggctagtgaggttagtgtctccttccttaacaatttcatattaatctgctgaagctatgcattaacctggaggatcaacttctgcacagaagtatattcctaaaattacgtattatgcatgtatgtttgcataatatacttccataaaagctgaaacttggctgggcacagtggctcacacctgtaattctagcactttgggaggctcacgcctgtaattccagcactttgggagaggatcacttgaggccaggggttcaagaccaacctggccaacacagggagaatttgtctctacaaaaatattttttttaaaaattagccaaacatggcggtgctgcctgtagttccacctactcagggggctgaggcaggaggatcacttgagcccagaagttcaaggttgcagtgagttgtgatcacgccgcaccactgcactctaacctgggtggcagagtgagcctctgtctcagaaacaaaacaaacaaatgaaaacaaaacaaaaactaaacttttattgagccattgatttagctatttttaaaacttccttacaatgtacaatcagaggcaaatctgtgttaataaagcctatatgttgcactggggggtcgcaggctagaagaggtcataacggtttaaaatttccaaagtgtcgattatggccattgaagaggctgagtcatcttaaagtcggcttgacattacaatcaaataatcagaaaagcccgtaaattgaattctactttggcctgattgtcttaaaagctggctctgatattaacggacggatgttcacatctttaatttggatcagggccactgacacaatagagtagatgagcctccataattttcaagtgaacacatgcttttccccattgatctgtggataatagatcattctattggctcccctgcagcatttaaatacagtctgcctaattcaaaattggtcagtaaatgtaatactaaactgccttgacctgaagacgatagaaatgaaaacccattttaaaaaatcccaggaaatcactgtacttgtcatatctactgcatgaaataaaaaatatatttcaccaaaatacacttctacctctattattttatagattattaaaacagtgcagaacatacaaggattaatataatgtgcaaagagatcttatatatatggccagggtctttcatgactgacagaacctctctgatgtttgctgactttttagccaaaaagaaagagaacatttggttaacacaggctcagagatagatagaattataataatacctgacagccctttgatacttggtagttttatggtgcagggaagggaaagattttgaagacttcattgggatcaaatgttaataaggaacaaggtgaaacatgcctgtaaaaataatattgattatatcacaatattctctatcattccaatgaataatccaataaccaatgaattcctaatagcaacattaatagggtgattaccgttttgtgaacatttattaaagaagaagaattttaaaataaagctatccatgaatttgctgttatgtcttaaaatactacataaacaccacaaggtgtctgaggtgtgccctatattaattttatgtttgtttggtaactccagtcatggtctctatagccaaagtcattcttcaaatatacagttatttgaactactcaattgaagggaaaatctggggtgacagataacaatgctttacagagtacatgtatatttaatcatagaagctcaagtatataggaaaataaaatgttagttacaaaatgtttatttgataattacacatcatgacaaagaatattataggaagtaaattcaaaatttaaatatattcatacagccaagatatgatccatatttattatgttgtcatgttttgctttataatctatcgtctgtttatgtgctagtttgtttaagtaaaaatattatcttcattttaaaaaagctgagcatgtaaaaaggccaaaattcggggttttggctatacttgaatagactgcatttgattttctttttgcaagctatacccttgatgacagttaaactgaacgagcattcattgagcaactatttagtttatagtcactatactagaatatagtgatacaaagatgataaaccatgatccctgtcctcagaaaagatggacgtatacatagcaactgtaatacggtatgtaagaactatacaagcagtatgaattgggttactcagaacaatcgagtgagggattcttctggcgcaggaggaatggaagtggcttcacatagaaggagctgagaatgcagaatgatgtaacagggctttccaaggttacccccaggttcagtgattcactaagaggactaacaggactcagcagatagcatactatggctataatttattacagcaaaaggatacggaacaagatcaacaaagggagaaggtatgtgtgagatgactaccagaggaaaccaggcccacgcttttaagagtcctttcccaggggagtcacacagaatgcacttaatgccttcagcaggaagttgtgacaacatgtgtgaaatgttttctagtaaggaaattcattacagactcagtgcccagagattttactgggggttgttcatgtaaacgccctaaaccatactgtctgcacaaacagtttaggcatagtaaacccatttgttatcagaaaatgctgggaacctttctgatatctaagttttcagaagcataaatattatggcaatgtactcaaaagaactgggcctccattttaggattccagctgaatgctaaccttgcaagcagtcctttctaaggacagcagcctcaggcctgttagattaactcttttctgcacaggtgaatagatctgtccagatatagttggtggagaaatgaattcaggctgtggaaatttcaagaaagggctcggatgtgtggaaaaccgttcaaaacatttcattcagtgagatgtttaatcttaagtgtttctgggactatttggagtgtcaagttcacactcctgaggcctgacatgatttcaggttccctgaacaggccccatcttgtaaagaggattaaaatggcaattgtgttaattcgaaacatttggcctctgttgtgtacttcattcatgtgaagatgtgattctaatttagaatatccagatatttgttttagttcagtgttttgttgtcacagtatataaagtttctgaccataacacctttgaagttgtatagttcaaaggtccctgttacagtgcaacggagacttcagtttcctggaggagagtatgtactttcaaagacgacatttcagagcatagtacattcatacaagtgatcgacacaaaatgtcatttttgtcactagtacttgtggcattaactataagctgtggagttgtgcttttgttttccccccagccagattgacatgcttcagtgcctttcagatcctacacttgtacaacccaaaacagaactatccctgtatttcactaggagaaaaatgaaaactgttaagcttataaatatttcactacagattgctgtatattcgctgctcactgttgaattcagctgctatgaaatgctaataactctctactgagggcttgagaacaacctctatttcgataaatattatggcgtgtactgaattatgagttccgtacattcactgatagacaagatggaatgttagccttattaatgcaactggtgcaatgtactcaaaagaactgggcctccattttagagatttagctggtaaggtacatgaccactgtaacatgcatgggccttagtagtataaaatagatatgaaatattgtacaaataatatctctgctgtggtttggaaatctattggaaaatatatacatttgtcttatcttctgatttgttaattactcttaggacattatgagtgaattttagaactaaaaagtcagtataaaaacagatggttacattttgtgattattagcttcctgtgactgctataagaaattgccacagacttagaggcttaaaacaacacaatttttttatcttatagttgtggaagtcagtccaaaatcagttttacagggctaaaatcaaggcgtaggcagggcttggtcttttctggggactctagaaggtaatttgtttccttgtctttttcagcttctagaggctgcctgtattccttgacacatgactgtttactccatcttcaaagccagcagcatagcaattcaattctctctctttctcacttctctctctctcttcaattctctctctctctctctctctgtgtgtctctctctctcatctctacttccatcatcacatctccttccctgactcggaccattctgcctgcctccatcttataaagatccttatgactggacccacccagatattccaggcttgtctctccatttcaagatccttaatcacatctgcaaagtctcttttgttttgtcaggtaacatagttacaggttccagagattgagattaggacgtggacatgttttggggatcattattttgtctcctacaaccccaataactctattttgtgttataaatactgtgaattattcagcaccaatacatggtattcaatcagattttgaccatgtctgtctatccatccattcagtaaatatgtattgagaacctaatatatgtcaggcaatgttctagatgctgaggtgcagtaattaacaaaggagacaaagtctttgttctcatggaggttgcattctagaagggaacacatataaattaatattggatatgtcctgaatatttggtctataacaaaaaataaggcaggattagatggcatactgtgttagtatatgtatgatgaggggtgccattttatcactaagtatggtcaatgatgtcctctctgaagaagcaatgtgatatgttgaatagtggcccccaaaatataggtccaagtcttaacccccggtacctgtaaatgtgatcttatatggaaatacagtcgaccttcagtatccacaggttttgaatccatggatttagccaactgtggatcaaaaatattctaagaaaaaacaaaacaataaaaacatacaaataaaaacaatgcaatataacaactatttacatagtatttacattgtaataggtattataaataatctagagatgatttaaagtatacaggagaatgtgcataggttatgtgcaaactacataattttatatcggggacttgagcatccttggattttgatatccacagcgagtccaaaaccaatccttcttggatacaaggaacaactgtattgtaagatctttgcagatgtaattcagttaagaatcttgagatgagattattctggatttgggtggagctaaattgaattataagtgtccttataagagacagaacaggagaagccacagagacacacaaagaggaaagccatgtggtgcatttacatgccaacaaatgccaaggattgtgggcaaccaccagaagctaggagagagacatggaaagggttctttctctgagcctccagaagtaacgaatcctatagacagcttgatttcagagttctggcctccagaactgtgacagaatacatttctgttgttttaagccacctagtatgtgtaatttgttgcagcagcgcaaggatactaatacaggcaatgtttgagcaaatacctatttgaaataagaaaacaagccatacagatactgaaaggaaaagcagtataggcagaagacacaataagtgggagactctctgtggtattcaaataacaacaatgggagacagtgtgactagaacccagaaagccagggggaagagtgtttgaagatgattccagaactatagtgctaaccaggtcgggtagggagggttttgtgggccatggtaaggactttgaatttaattctgtttattatatataagctagaataattatgatttactgaaatgtagtgtttctgggcatgacagttttaactgccagaagcaaataatcgtgacacaactgaatattaacacaaaacatgaaggttgaattctggtgagctccattgtgttcccagtaacttaactatcacatttttaataatgttggtcctggcctgaataacaaaatatattggttcctccacccccaacacgcaactactgtattaggccattatcacattgctataaagaaatacctgagagtgggtagtgaaaagacgtttaattggcccacagttctgcaggctgtataggaagcatggtggcatctactcggcttctggggaggcctcaggaaacttacaatcatgcagaaaggcaaaaggtgagcaggcgcgtaacttggcagaaacagcagcaagagagcaaggggggaggtgccacacttttaaacaaccagatcttttgagaactcacttagtatcatgaggacagcaccaagggcatggtgctataccgttcatgagaaacccacccccatgaaccaatcacctcccaccagtccccacttccagcactggggattacatttcacgtgagatttgggcagggacgcacatccaaactaatcaactacttatttctttttgtgtctgcatatataaaatctgttaggtttggctttccgtgcaacactgtttcatgtgttattagtatcgctgttacactctgatactcccacaagataaccctacccatcaatgagaattgaggccagtactgcagaatgaggatcctacacaaaatacagaaaccttacttgttcaccaaaggtgtgaaccagtagtaaaatgaatggatttgtttcccgtccccttgctggtccctgctaactctgactcttaaaagccataacattttagccaaagaggacggaagaaatagactcaaaagttgcttattaaaacttgcaatatgtgtgccaataattgctagaactgtgttagaaataaggacattgtaatgagataggatgttatttttctaacatgatgtctctatgttaagagataaaggtcaagtcctaggaaatgaagggctactttttaatggcgttgaaaccacgtaatgggtaggattgtctctagaagatcagtaatgcactgatacataatcaatggaagtttcttaggagatactttatttcttttagcattggttcctctccctactatgtcaaatataaatatttcacattgtatagccattaatcaaagtaaaactaaccacagtctatatatatatatatacatatatatgtatatatgtatatatatgtatatacacacacacacacacacacgtatatatgtatatgtactctgtatgcatatatacacagtgaattttagcttatgtccctatgggcagggaagagaacaaaagatgcatataataattcatctctgctcattttcccatgctccttcattttgtgtatcatctcacatgcaaattaaaatgttctaaatgacaaaagaaaatctcagttgtgggaaattaagcataaaatgtggactgaatcttgattttgaaatcctaagggttactaaaaatagaacatttcacacccctttcaagggagcacctgctaaattcatttgagtcaaatgtagaaatctctgtaattcgagtagataaggataatctagaaataagaccacgagcagaggaatggtcaatgttttttgtagccaacagctttgaaatatgcttatagaaaacattgcttaaatcaggactattttaattcagaaggaatctacccatggcctactaaattatcatcagagaggtggtcaccacacattggtttagtgaccaagcttgacatcagaaggcctgaattctgcttctgcttttattattagtgagataactgatctcatgcaggtcatttaatttcactgtaattcaagttctttatatttacactgagttgtgtaaaaattttaaaaaacaaaatacagcatcattttaagctgcataaaaggtagaaaatatatcatttttaaatatcaccaatgttatcaaaatcatatatccagacaagggatctaagtaatttatctatatagatggcatagatagactacatacactacttatgttcctcattttgaatgtgaacagattagccatagcagtaaattccatcgctgaagaaagttaaatacctttaagaaaaatacaagcctgtccttccagttgtaattttctttcttaatgtgctttatctttgatttgacataatgaaggtttttatcctgtgcccagaaatacaaaaacatgagatctaaatatcttttttggttacttccccgtgctttttcattttgttttggtttaatatacaaattaaaatgttttagaaaatattgccaaatttgtacattttgaagttttattctggaaatatgatccattctgcttattcttttaaaatactacatattttcattaaaaaatgatctgatgtaataaaaaaaagtttttgcttgagaattgtatcagtagatacaattctcaaatagaagagttcaactctttacagatgatcagaagtatatttcctttaaaaaagtgaaacttaaaaatcacacatttttagatgatgacagtttcttttgtaggagagtgtgtacctttacaagatacaaagagaaagaacatttgttatcacaatcataaatgcaaattgtggactcagcctagaaacttaaaagatctgtgtagaatgatttttctccccttttatttccagtttaattgttttctgtcatagacttttattgaaacaaatacatgctactgattcttccctaatcttacgtggctaaagctaatctttcttactatttgcttagtagaaaaaaagcaaacagcaccacatattttttttcttttccaaaatatagcaaaaaaaaaaaaacatcctattatttcattccaaaagcagtagtccttttcagacttgtgcagagcagcttatcccacagggatttcaaatagtaactcattggatgcaggtgataaggactttctatgaaaggccaaagcaactaaatagttatggtttttgtttgtatttaatattattttgttgtggatgcgttagtcatattttttcaaagggaagcaatcaagtgtgatagaaattatgatggaatgcagactggactactgtcaagagagctgagctctggtctggactctgtcactgacttagtatgtgcctctagtttccatgtttttattttattttgagacagagtctcactctgtcacccaggttggagtgcagtggtgcgatctcggctcactgcaacctatgccttccgggtttcaagcaattttcctgccttagccccccgaatagctgggactacaggtgtgcaccaccatacctggcaaatttttgtgttttcagtagagatggggtttcaccacgttggccaggctagtctcgaactcctacccttaagtgatccacccacctcagactcccaaagtgcgggggttacaggcatgagccaccacaccctgtctccatgtttttaaaataagaacagcaagatttgctcttaccaacctcatgggaataacagcaagaaaaaaaaatgggtaagctaccaaaaaaatcttttatttttaagaagaaatgtagttttctatttttggtatattatcaaattctcccttatgttctgacttacattaaaccattacatgtaaacatgtaaataaatattgatagtctgtcttgaagcctgactctgatacctgaaacctgaaatacagtcctaattctatagactgtatagtctgaaatgtattataaggaagagactcttttaggtgctgggatacctggtgaccaagataacccagttcccctacaagtttgtattctatgaaatagacaggccctatacaatgaaacaagcaaatattttctcaggtattgattagtgctgtaaagaaaagtaaagccagctaactgaatagaaagtgtcagaggaggggggacactttcatgaagattggtaagagaagacctgtctgagatggtgacataagacctgaaacctgaatactgagaacaactgagctatcgaaagctttagagacaaacattccaggcagagggaacaacaggacataaggctcttgaagcctgaagaagcgtgacaagatggaggaacttgaggcttactggcctggacagaaatgaagggggaagagagctttggatcaggtcgaagaggctgccaggggctagatcagacaagatcttgcaaaccgtgaaaaggagtttttattttattctcaataaaaagagaagtcattggaaaaataagcagattgttaaaatgacctcaacatgacagaattgagttggggagggtgtcctcagagtattacccagagaacttggccccaaatcttttacagatttctcttcctctcctcaaactttcccactcttgagtggctaaaatcttaatctctttctctgtctctctcaacaagagtgaacccgatgcactgcttttccttttaacatcttctttggcatttaagggcacctgagtgtagtcccttgggaaagtagattttcttcttcttcaaataaggtcatcacattcttcaaagaagaaaattctggtgagtgaaattcttcctttctgcccaccatctacctacttacttaaaccttagcagtcatctgtcaaggggatcagtgtttatttgtgcatccagtagcactttcttgtcatagccccatgaccctgctccttcagattttctcaaggacctctggagatgtttccaggttaggcatagccatgtgtttcaaaatgcagtccaccagttccaggacccaggacagaaagaactgcctgtgccaaatcttgttgaggcttaattgggaccttaaggacccttcaggacctctaaggcctttccaaagagcaagaacatgtgattcccggatgaaaagcctcatggttcacggctgccacaattgaggtggtgcagaccaccctctcccctgctggagcccgtaaggctcggtgtgggtggcgactgtggaaagcagggcaggaatacattgccttccagaaggaattcaccttattgctgctcgtggggacagtgttagctggtatgctttggcttcaggcagctgtgcctcagttcacccttcagccagtttttatttttcagtcttgagcagcttcacagacagtaacaatgcagcctatattcttccactaaacgcagtctaagattattcaataatatttggctattagttgttcccacaataacttcatctcgaacttcgagccttccaaattcagtgttttgtttcatcctggatagaccttgatgagagttcttcctattctttatgtaaataataccaagaactttctccctttcctttgaggaggtaaagttaggaatttgacatctgaatcccagtatctgtccagattgccatgttcacctttaagtcagtaagaaaatatgccttcaaaactgcattttgattcgtttctaatggaaaaggtggggcagtggcataaacaaaaatcttgaagaccctcatatatacagtctcagtacttctaactttaaaatcatcttgacccatatttctgtatctctctggttgtatttttaaaaccaccaaggctcctgtctgatttatcatgcccctttatctcttaaatcctggagttatgtcagccatgatgaaaatatacaataagctcagctttttatccaagttgtggctggatacctttgggacacaattctgaaaaagtagtcccaaatatcgcccgattatatagtacttcccctcaaaaggctggtaatgcacccatgcaaacaagaacaaattgaataactcaatttccagaaggccactgaaataatgtagagccctgaaggagaatttctataggggatttcaactggtttatcatactgaaattattttcaagaatccttctagacatttattggtttctcaaaattgtcctgtttaaggcagtaaccaaaacatcttgccttttctgtcatgcctacccctttgagttcacttccttcgtttctgtgcagtgatgctctgtcttggcttatctgtacataggtcactctcagacatgcatagacctgggggagctgtaggtccttttctgttctgatggcttttcttgtgggttctatctccttttcccttccccactaccatgcccataattctatcaaagaaaaagaaaaataatagtaaaaacaagaagctgttctttgttgtggctcattggtaagcaaaagattccatttactttaacaaatatatatagattgcctactgaatattatggactgcagcaatcagaatagcaagttattcttaaaacatagtgatgctcttaaagtgttttagctttgaattgagctgtctgctttgattcaaagtcacacagagactgctcttggaaattttcccataggcccaggggccactcctcggatttacagcaatgaaaacgtaaatgaatctgctcacttaagggagaccaagctgtgcagaagtggtgaatgttaagccaacttgccagaaactgatttataaaccagaatgctgattcattaaatgaaatgggagatgaatctggtaagataaccggcatcaatcatttgaacagggtactccctcttaatgaataagctcattgaagaaactaaattgcagatcagaaggatttttggtacagggaattagaagagaaaaaaaaagtgttaaggggcattcccttaaactcagtttactcaatttgttcctccccattttggaagtctttcagtctacgaatctggcagcagacactggaatgatgtcactcttgggcagttcttgcctttcatctaactttgatctcttcttcattcataccaccaaactttttttgggacaacaaagccctaacattgttacacaaatttaggtcagagtttattttgtattcatgacagttagtctcctgtacctttaggagataaactacagaatccagtaaagagatttgggaagtaccttaaactcatcagcaactatctatataaaccatttttttatagtcagttttttcaacagatgaataaccatgtctgtttcagcttaatgcttattagcttcaattttcaagaggtgactattttcctcattcaatttagcagctacttactgagctcctcaagagcaagaaaagtctccagaggaaacaaaaatgagcaaggcaatcctttatgaagtttacagtcagatttgagcaataacaacaataataatgagcacaaataattatggcacagaattaagaaatcatgtaagagagtctgttccagaaaatgaggcaatcacacagctgactgtgagaatcctgtggcttttgacttggaccttctagggcacatggggttttaccaagagagataagaaactgtttcatgcagttgaagagaccttggtgagacacagcatttagagagaaaagccccagacacattcagagaaaataatgggatggaccctatttgaagactgcaaggagtacatgtaaaaactgatctgccaattctattatggctttaaaaaaaaaaaaaaaaaacacggccaggtgcagtggctcacacctataatcccaacacttgggaggctgaggtgggaggtcccttgagcctaggaattcatgaccagcctgtgcaacaaagtggaacccagtctcgaaaaaaagaaaaaaagaaaaaaaaattagccaggcatcatagatcacttgagctcaagaggaggaggctttagtaagccgtgattgcacaaacgcactccagcctgggcaaaagaacaagaccctgtctcataaaaaaacaaaatctaagacacaacaaaacaaaaaacaaaagccctgtctctccttagaaccacaacagatcaagttatctgatgctttttttttctttttttacttttatgggtaacacttgtatttgaaaaagaaaagaatggcaattaaaagttaattattaaggcaataagcataacatttattaaatcgatttagaagcaacttgattataaatcttttttcagtagaattcagtcatcaatcgctgttccatatataaccatctattcctgatggtgtaaaagaaaacatgcaaaattaatataagttctttaatttctgaattttggcaatccctttacgctttgggtgactgattatctgtcattttctattatatgatttcactcagaggagctattttttgtggtgttataattagaggaaaaccaataatcgataagaagatagtttgaactgagcaacaagattgttttgattcaatgtttttaactgattaaaagtgactaacgtattttgttttcatccgtgacatgtaaacaatagaagggaatctcgctgtatctaacttttttccccaaacccctctctcattctccttccaaattttcgaggtacgaaggatgactttctgacttcacataaattgcccctgaaacatttctgtagttagtgacagctgtcttctacttacttccaggagaaagactttattcacacaccgttaaggctctttttactggcttgagcagcttacaaaagagagaaaaatgtaacgttatcaaagactttcttgtggctttcactttatgctgtcttccaataatatatactggtacctaaacactgagcagcatggagaaggagtggcctgacctgggtgaatttaacttacggagacagggctttctaagatgacacaggaaaggtattgatgagataaaagccactgaaggaataaatcattcatatgatattttatttttattaatttctggttcagctaaaagtagagaaatatcagatgaatgctattccacctagtcgtcagaattgacaagccacccaaggtcaggattgggggctggtctggttctggaatcagatggctacatttgaatcccaacttccccttttcactaactgtgactttttgggcaagtgacttaattttatacccttaagttaattttttctcttattcaatggaaatattaataatactttcctggtttagagtaatgattgaattatatggtatatataagacatcagtacaaagcgaggcacagagtaaatcaagcaataaatggcaactattataaaaaatggggccaggcacaacggttcacccatataatcacattttgtgggggccaaggcgggaggatcacttaaggtcaggagttcaaaaccagcctgaccaaatagcacacacacacacacacacacacaaaattaacgggaggtattatttctctataacacctatttaattgttctgggcaggcatttgtatacctctttatgttctatctgtcttcgtaaattatagaacacccatggctgtcactgaaagacaacttaagcagacccttcaccatgcccagtgaagaaacagaaagagaggaatttgggggattagtatccaagccattgaatcattaagacagaattgattgataaaaggatttgtgtttattaccccagatagtgaatttctctcagtagaaagagtgtcttttcatatcagtgtaggaggaaattcattacccattaatttcttaatgagacaaatggtaggcatctactggaattcatctatggaaacatgtttgtgtatgtgcataaacacaagtacagaaactcacatgtacgctcatatgcgcatgcgtgcacacagaacgggagagaaatttgttgactaattcttttatctttaaatatatgccatttttactgagatcacactcactgagtgggaatttgagagttattttagggttatttttggtgtatataattatctcaaggctctagataaagatcctggagttttaagcccatctaccaacattctggtttgaataagttatttgaaccagcatattagagagaagataaagtcttaagatgtgaggttataagattcctttttttcacgagggcagctaatgctggaactgcacgagtggcagaggtagggtaggagttgacttttaaaagcaataataccccttagccccaattttgggttttttttttcaacatgtttcaatatccatatgttaaaatgttgaatatttctacatctaccatattcacctatgcctgcttgtgaatttgttgtggagggttaaagcaagcaggacaatgtctgtctcatgttaactgctcagaaagtggtagctactcttactgtctcagacagtacctgagtctctcagttatccaccatcagtgttattttcttattaccattagctctcaaatggtaattttcaatcttttctacatcaaaaaccccttggggaatttgatgaaagctatgtatcctctattaaagaaaagtgcgtatacctacatgcatataccatgcaccatttccatacatagtttaggagattcacctattccatgaattgagagttttggtacaccagtctaagagctccagcacgagttgagaaactgctctttcatcttttaaggatacattccaagtgacttatatttgattttagaaaatactggtgaacatactccaaactacttccttgaatcttttctcttgggtcttgaggtaaagcctggaatccttgatgctctggaaactcttcagacagactaagattacttaaatccgtcagtacctcctgggagctggtacaagatgcaattcagaatttaaaattattcagaatgtactaagatgagacagtttatatatgcatcatgtattacatagcatccaagagagttcagtggcagcatcacataacgaaacagattaatatttcttcatcaaaacatgtgaatattcatattaagtgtaataaggactgtagatagcctcacagtagtttcttttgctaccaaatgagtaacattaccataaaaacaactttcagttatcagagcttttagaaattcagaattgcaaataaggatttgtggatctgtagctgaattcatgtatccagggaatcactataaaactcacatccctttatatttctcgactatacctaaagggttataaattgtatactacaatcagccttagatatcttgtagtttgccaagatggatagtttataaatttatgaattacacacagactacatgcatataaagtaatatatatgcataagtgtatattgcattacatgtattagtctgtataattcttcttttagcagtattcagcaatgcatccaagtagctctacttaaactagtatatattgcttgcctagcccaataaggacatataaatcattaagaaaagatttgaaaattatagctggaaattagaaaactgtctgcaatggcatagtttcatagaaacagaaaatggattgagtaccatacttgaatctggagcccctctcagcttcacttgaaataattttgcctgaaaattgcataacacgagttcactgataagaaaagcaattaattttaataaaataagtacgtctaaatttaaactatcttttagatttcaaatagcacaagagaaaaacttccacagaagtttaaaacgtactgagaacattaaaggaactgccaaataataataaaacataataataaaacccctaaatttaaactatcttttagatttcaaatagtgcaagaggaaaaaacttccacagaagtttaaaacctactgaaaacattcaaggaactgccaaataataataaaacaaagtaaaccaaatttctatgtctatgtccatatttctaactatcatattgtcttcaagtcactgctaaaataaagtgctatcaatgtaaaaatgctgaagactgcttctcccttcctttcaaagaaaatctgacatttagatatgaagaatgacaccttcttatgcctccttcatctcccatctatctagaataaattgaataccttgcaagggaggcaaaactttatcttcacccttttagggtcttcagctggcctgagaactaaattgatataagacagattgagaggggaaaagcatacaaatttaatatgaattttatttgacacaggagcccttgtaagaaaatgaagaaccaaacaagtggtaaaacctaaatggttttacactagattggacaaagggaggcaattctggaaaagtgactgactaagttgtatgaagaggcaaagagtatgggagacaaagagttattttcacaaggtctgtttgtacagaatctctaggctttgactctccatctctggtgatgagaatgtttattttcttctggtataggaaagacatctttcacttgggagtttcatcgcttgctttcaggaagaaaagggggagatcagaatgttcttcttgtacttgctgttttccaagtgcctttagctcaacataatccttatgccaaagtggcatagttgagggtagcaaattgtgccacccttcaacctcctggtgttccaaattttgctttgtgccttgaaggaatctaacagaagtaccagaaacacccttctatgagaagaatttacagtctatttagaaaagatgacactagggtggtatggatcaatacagcacacaacacacaatacaccgtaaagtgttttgcacatcataaaaactcaatacatatccgttgcttgattatagaacgttcactttcacagtacctctgaccttttatttttcaatttagtctctctgcagttcctaggaccacatatactctggggagtgcaaaagagacttttacattaaaatatatggaagtgccactctgtaagcctgaaaaagcccaatgccagccattttttatggttcattgtggcataagaattgttctagaatatgttaccctaggtcagttactcttttattcatcttctaacctcaatcttggactttttgtattagagcaacagccacctcctacccgcaccatgaatttgttcctaaaatctgtgtatctcaagatcttcccagtgataattgtttaccctggagcttggatattacctggctggacatctggctaataggccttgtgtcagttttcttttccctccagacttgcacatccctgagagagagtgttttgtttttttttaaattttgttccctaggctctttatttgcctcattttagtcctagtcctgcatggcatcacacttgatcatcaaccctgagctgtctgaattcagccatccaaattccactgaaatgttctcactcctaagtgggtatttttcaccctaatcatattacctcctctgcagcattgggcactgtgagtcactctatccttaccaaagctctttcctctgttagcaatcatgaagcagctgccttgcttctctgtacatctgtacttctctaatcccacaattaccacttaccttttgaatctacccaaggcctggtcccctctcttcttttcattttaaattttctctgggcaatctcattctggaatggcttcaactgctaactacatgatgatagctttgtaaaccccatctctagttgaaacttctattctcaactgccatctcaacctggaggtatcacaaaggtcataggctcaactatttatcctcttcaggttttttcttttacagttggtaacaccatccagtcacctaaattaagactttggaatttacctctgatggctctccatagccaatctaccaccaagtattttctttcttttttccctaaagccttcttaaaactgtgtttttcctccccataccttctgcacttgtaatggagatcaccaaaagttacccaaagccctcctcagataacacctctgaatgtgatttttcccttttcacctgagaccagcataagaaccatctagaaactgatgctgtgatagcatgaattattttcatacacctttgtatgtaaataatttccacataaaaatttctatattacttttttatgaaatgtgttaaaaattactgaaataaaatacttctactttgaaccaatttatgaacaatatttctagaagagttatagatattctatacaaaatgagttcaattgtcgttggtttttaccataagacattattgataaaatcctaatgttggaatctaataaatacttacacagaaagggtccttaaaaagacattaaagtgccattgaatgtcttctagaagttacatttaaagataaaatacattgatatgcttttaacttatttgggcattgaataaaagacctttcttataaatgagcataagacgattagtacaagagtggtgaggactgaaaaacaattcaagataggaaatcctgaaattgatgttactttataaactctatttctaacaaagaaaattgaaaaactttgagtttttgaaatgtataattattctaatacattgagaactgtttatcaattatgaccaaggatacttcacaaaggctagtaagcatgtcattctatgtcaaatcaccctcccgataggtattgcttaagaacctgctaggaagagtgatgtgaaaaataatacaaggaacaatgcattgtttttattccaaattagcttataatttagtgtgtcaataaaccatataaataactataatactctagtagcatatgatgcggcttgtaaaagccagtcacagagttaactgatgtgactttttaagttagaattaaatttttttttattatacttgaagttctgggatacatgtgcagaacgtgcaggtttattacataggtatacacgtgctgtggtggtttgctgcacccatcaacctgtcatctaccttaggtatttctcctaatgctatccctcccctatccctccaccccctgacaggcccgtgtgtgatgttccccctctctgtgtccatgtgttctcattgttcagcttccacttacgagtgagaccatgaggtgtttgattttctgttcctgtgttagtttgctgagaatgatggtttccagcttcatccatgtccctgcaaaggacatgaactcatcggtttctatggctgcatagtattccctggtgtatatgtgccacattttctttatccagtctatcattgatgggcatttgggttggctccaagtctttgctattgtgaacagtgccacaataaacatgcatgtgcatgtgtcttgcacaaaatcactctgtcaccttagcacctctttctttttgtttgcctttggaaaattctgttgaaaaccctttctaaattcctgcccacaaaatattataaaaggaggagggagataaagaataggagtaagaggaggagaaagtaatgaactgtggttaaagattaaagctttttcagaaaagcacttatcaaaagtttctaaagagctcaggagttaatgctgtactttttaggcaataatggatgggaattgcttttggaaagcactcttttttcttgaagagtgcaaaaaatgtattcctttgagtgaatgaaaatcaatgttatggtcaaatatagaggaattgaggagaaaacaaggacaagaaatgctctaaagagaagactttgttgcctcttttcttcttcatcttaggaataggatatcaatatttgaatcatccatgggagcttttcaaaacccctattcctgagctctacccccagagaaatgcaatccaaatctctaaggataaaactcaggtgtcagtattttaataaacttcccaggcaattgtgatatgtagtcacagttgagaaccactgctacaacagatctaaaaggcagaagccaagtaatgctttaatgaagaatttgagaggaggaatatacatcaccctcagctactgtcacctaactagctgatcctggtaagactggtagaaatatagcatccaaaataagcaagggataaaagactacaaattgggttcagtgtatactgcttaggtgacgggtgcatcaaaatctcacaactcaccgctaaagaacttcctcatgtaaccaaaataccacctgttcccccaaaaacctatggaaataaaaaataaaataaaaataatgaaataataaactgcatttctcagaggtgcaaaatacccaaaccctaaatttaaaaaaaaaattagtgagaaaaaataaaatttccctagctgttaaatccgtgatgtgatatttcttcttttaatctgaatctaaaatgttcagtcttggtccaataataaacacactcactgaaacacacagtaaagaatctaagcagggtgagggccatggctcatgcctgtaatcccagcacattgggaggccaagatgggaggattgcttgagcccagaagttcgagaccagcttgagcaatgtagcaagaacctgtctctacaaaaaattaaaaaataaaaaaaaattaaccttgtgtggtagagcatgaagttgaggctgcagtgagccatgatcacaccaactgcagtccagcctgggcgacagagcaagaccctgtctcaaaaaaaaaaaaaaaataagaataatctcagcatttgagaagatgataatatggaaagtcaggtgtgaggtcagcatgtgggtgaataatttcaaaagctcttatttcttaatatcagtaaatatattcccctcttacagaattcatgcatggtattttggggtgtgtaaaggtacctctcacttattctcattctgaaagtctttcacttccttggtggatgaaaaggaaagctgcagttggttataaaaacgtgacggatgatttaggtggctgtattcagctgtaagcaataaatgctgagctcggcagaaagtactataggcaaaaacgtgtgatttactagctatccaaagcacatgagatttataatgcatgagaccctcaggcccatcacttctcttcagtaatgggaaacaatattgtgggaaaaaatgacacatttaatttcaactttgtgttgtaaaacaaaaacgcagcctaattttcattttattattattttttttcttttcgtaaagcatctttgcatcttattggaaatacaaatggcttcttaagaagtaggaacaatagagcatgttcaaaacaatatctatcggtagacatttattactggctgcatgtttgtacgtgtttggtgggatgaaaatgagaaacccggagtgctgtgacagactcattgtgttctgatagactctcccgaaaactgattctagaagcttagtgttctttaaggcagatgtttagccaggtgattgccgtggttacctatggataccggataccgaaaagagtcttggcatacttaaaaaaaaaaaaaaaaaaaaggctagagaaaaaaatagtagagacattttttacccactgaactgagggtgaaaaatgtagtcacaaaagaccatgaactcaaatcccaactctgttaatgatatataatgtgaatgccataaactttctgtatctcattatatcatcctgtgaaatactgacctattttgcaattgcaatgtgagagataaatcaaacctcttctaaggtactttgaaaatagattctgcatttcagaataaatattaaacaataataatgatgatggaatagctgacacaatgcaaattttaaatagagcagagtaactttctaattatgagctacattttattctttgtgagtgtaattagaaagcgaccatgttcctttaattagaaagttaattagactgtgacctcttttcctgtcttactgtcttggactacaggccaggagtaaattgcaaatcccctgacctacatgactatagccccccaaaatcagactgtttaaatagaaataacattataaggaataacattgggacttgcaagtcagatggggacttcataggctatagaagggttctctcatgagagaaaagtttatgtggataaataaaaaagggttctctcatgggagaaaagtttatgtggataaataaaaaagatacttttccagatcaagcctatagagtaagttccctaaattgtattcaggatgttggttcctttgtccagtgactctattactttagtatgcatgcaagagaattacctgaaggacttgtttctgggctccacacatacaacttttttttttttctttttttgagacagagtctcactctgtcgctcaggctagagtgcagtggcacaatctcagctcactgtaacctccgcctagcgtattcaagcgattcccctgcctcagcctcccaagtagctgggattacaggcgtgtgccaccatacccagctaatttttgtatttttagtagagacagggtttcaccatgttggtcaggatggtttcaaactcctgacctcgtgatctgcctgcctcggcctcccaaagtgctgggattacaggcgtgagccaccgtgcccagctgcacatacagcttctaattcagtaaatgtgggactcgagaatttacatttctaacaagtttccagatgatcttggtgacattggttgagagaccacactttgagaactactgacttagaatattaatagtgttaggccgaagtattgttttgtgatcaaataagtttggaactttcaatgttgaacaaagttaagcaagtttgttttttgtgtgatacctcaaaacctttgaatgttaatatgctttggaaatctccaagaaggatagactgcattgctcctgaagggggtggcccttacaaatgttttggctctctttatctcggagctacaaacagaggttttgctatttcacatagtgttcttagaatgggttgttagaatgctttgttttttagcattaacagaagaatgtcagaaatgagtttccattggtgtaatttgtggtttccccatgtgtgtactggccaaaatattgtagagacattccctactcttgtatgaagagggtatacaaatctagtaaggtttcaccctttaatgtgagaaatggtactgtacatttgattaccatttttggaagtttcttgattgcctggctcctgatagcctaattagctgaattatttctctgatcttatcatgtttacctcatatgaaattttcatgtaaaatgacatttggaccactttaaagaaatgtgtgacttcatagagtcgactgttttgagctagcttgttcgtaaatgtctaaagaaaaatttgctgtgaaatttgctcacattacaatctagaagcaaaattcctagagcgagaggttaaccctctgccacttctaaccagtggcaattatagatacttatcagaaaagagcataataagttgtgcaagatgagattgcctgaagtcagattaaaacactgcccctgctccccactccaatacttgtttgagtccttgttttcaaaggatttcatgcatccagtgttattcaaaaacacttgcgaaaatgctgtgtgattatttttaacttctcagaacaaaaaagaccgatgtcacaggaaaccaagcagcattagtaaactggtctgtgacatctctattgcactctgtgaaaattccatgaaaagcaaaatgggaatacaagaatcacagagaaacaaacaagtggagaagaggcaatgacttcatgtttatgttcttggtagcaatttcctagggaaataataacttcagagaaatagtcaatttgccttacctggtgtgatatacgttgtatattgtctaaaaaataagtgctctagaataggcaaaaacactttgcctaaaaagttgtgtacgtgaatgatactggaaaattcaatgatagcctttttgtctgttctcattttgtgtagttgagagcaagatgctcacaagtacatattaatattgagtgaaattaagaagtctcatccccagaataatgttgctcacaaaatagatgctcaataaatgcctgtggttgcattgggctcatttctgttcatgtgctgtttttttcttttcttttcttttttttttttttttttttgacagagtcttcctctgtcaaataggctggagtgcagtagtgcgatctccactcactgcaacctgcacctcccacattcaagcaattctcctgcctcagcctcttgagtggctgggattacaggtgcacgccaccacgcctggctaattttttttttttttttttgtatttttagtaaagaaggggtctcaccatgttggtcagactggtctcgaactcctgacctcaagtgatccacccgcctcggcctcccaaagtgctgggattacaggcgtgagccactgtgcccggccacatatgctgttttaatttcaacttattacatggcttagaatatatttttaaaaagatattttgatgacacaatgaccctgatctataggaatgccatttttagccagaattaatatagagcactctgctttgggattagctttgggttcagtttttggccatatcatttaccagctcagtcatgggaaggataccttggaacatttaataattttttggagtttcagcttgattctcccaaaatgtgactgattaaatcttacctaatacgtcattcattcattcaacaaacatttaatgaatgtccagatgtgacaggtgctgctccaggactgggggccaggagtaaattaatgcattagctgctctcatggagcccacatctggttgcacaagacaggaaagaccaccagaaagtacgtagtagaatatcttgggataatgagcaccatgatgagaaataaatcagagtaagggaacagggagaattataaagacgctcttttattaagaatcaggcacagcctttctgataaatggaggtttgcaaagacgaagtggtcttctgtgcacgggacaaaatgagataaagcatacacaaatagattgtgaaatatttgacgtggtgttaggtatgaagcaaaaaaaaatctatttcattgtgattaccattaccatattatcactgatgttgatgtattttcagaaacacctatctcgtgtgcatatttggtagacaaacctgaggaaagaattcctaactaataaaaagcctcataaatcaaatgccacttaacaaagggaccagtcttgttaacattgctgcaacagaactcgagctctcaccactgctttagtgagatcattaatatgatcattgcaatagtttgtgctcctaggattattgatagagaaaatgtgtatgataataactattaaaaatgatatcacccatcaccatcaattactgattcctctgtatgcatcatacaatgtgcatagtgctttatattttctattgctgttagttctcccaacaatcctataaggtagatattcttaagatgttgtcaaataacttgttcaggatcacccgggcaactttgtaatcagacctgggatggaagcctggagcagagtgaaaacaatgcccatggcctattgaccacattcataataaaatatatattggtaaaaaaaaaataaaattacaagactcttaaacttttatatgtttcagttaacattatgaaatagacaactaaacttttgccctgatttggaacccagacttctgtgtgctctttgttttttaatgaaaaatgtgttttaaatacttctgtggtctgaaagtatcccctagaattcctattttgaaaatccctagtgtgatggtattaagaaacggggccttttggaggtgattaagtcataaagatagaaccttcatgaatgggattatcaaccttaaaaaagagatcgaagagagtggcctaggcccttttttgccattccaccacttgaggacacagcattcaaggcaccatcttggcagagaccagtcccttaccagatactgaacctgctgataccttgatcttgcacttcccagccttcagaactttgagaaataaattctcgtttataaatttcccagcccctatagcaacacagactaagacaaataccaaataaacataaaataaactcttggagaacacatttgcacacccaaaacttcctgaagatagcaattcctagaattcgaagcactgagagagtaaacaatttactttaacttttgaaaccatgcagcctcccctcaattccatgttttatccctcatctgtcgatagtgcatggtgctgtaggtcatgatcaaacttccaaatagaatcattcatacaattctaagtcatcattaaggccaattcagaacgtggagattttataatttagttgctgtttgagaaactgaatacctaagacagcttatttgattattgaactttatttagtggaatgacctctggtggcacaaataatagaaactgctttcaaattatcattcagggtagcttgtagttggccatgaatagagagacaattaagtagcaaatttattacaaagcaaattccccagtgacctactgtttttcttttctagtgaggttcctcaacgcataatcctattacttttggcttgaatgagctagtcactgtcttccaagctgaactatgatgttacatggaagtttaattttcatcttatttaatttgaccttaagtgagctggatcatgaaaaggcaacataatctccaattctcgacgttaagcgtcttttaactactctacccagtaatcattcccaagagacattgtgaaattgtttaaaaattggtcacaaatgctaatgctaattttatgcccccagatattttggcatctctttcttcttattgtgccttttacactgtgaggcacccagcaggacattcctatggatggatggacttaaaataataaattccaaccaccattctctctggctaggccccctgctctaatgcttaacacaatgcgtggcacatggttagcactcatttggtgttagttgtctgaatcacgaactcaacgaattaatgaatatacaaatcagctaacaaacagacagcagaatgttgaccttctactttctctcatttgtttgaagtgcaattcaagaccggagaaccaagtggacaaaatactgcatatagatacagcagcaaatgcttaatgacttaaatatcctggaaatatttttatatcttactctgacttttcacaaacattaaaccaaaggaatgcttaactggcaattttaggttctcactgggcaaactcatgggataggcagtgtggagaggggcttgcatatgttttttgcatcatttcaataccccacatctgagagtgtacaatttgggttagatttccactcaaccggttggaatttcaggttttggactacgtcctctctatttcctctttatactttcatatttggaaagcatgatatgagtactgtcttagggagaggatagacaggaaagggaagctactgaaagccttcttttgaaataataatttcttaatctatgcactaacacacaagagtttatatctcctggaattttaaagtaataattgtagtgtgacaaaacaatgttaagtcataagatacatttcaacgttttaaaacacacacagaatacatcagtgcccattatgtgataactgagagattaatttgcaaccaataatatccttggtattttagcgttgtggattgtcaaaggcttgcttattgcaggttaagacattaaagggcccacattcccacttcttattaaagggagactttacgaaaggtaggcactgtctctacacttctgggaagaaagcctggtgatacgtaatgctccccctagcagaaaaatagtggtcaccagaagcatctctccataagataaggtgagacaaatagtgctgggccaaaccttgtgaactatgggcttcaacaaaagctaagagtctcatcatataactctcacctagactcagactatttcaagcaagaattaaggtaatgacatgaacttcttgccacagttatctctttattataaaatgtccttgactacaaggaggtgtaaataataactgccattccatggataatcagggtaagctctatacattgtctgccaattaccatgtactacttgaaaattgttaatttagttgaacttgaaaaaataaacaagtggccctctttggcatagtctagaagagactgcataggaaaaatgggaaattaaggtggaggatgatggatggggttctctgagtacagcagagggggcaagcagaagagttggagcatcatgaatggggtcacagtacattagtatggcttctttggcttgattgtggaaatgtgagagacaactattgtgagattcaaagacagtggtaacatatataagaagtgactgacaagatgacagccactcaggaaaactgcctcagaaggcagccagaaaggatcaattctggaaaatgactggcggaagctattaggcatattgaatgggtctgacttagtggttgatttgacaatgagagcaaaagatagatgttataaaacatcattcagagtcaatgaatctggctattgccaaagacagagaaatgaaagaataaaagggaaggtatggggaagaaaataagaaaaaaattaaatgattatctttagtttctgcattagttcttctgctttggaatctccctagctgcctgcagccaggggcaaagatagtttcacctagagggtcctgattgaggctgaggatacctaggctcaatcacagcagtggcacttcccattcagaggaaggcttaacattaattatgagacatgagatccaggtgctgaactgacaaatctattctctctcccaaggcttcccaaatcacagctccgataggcagttatcctagcttgtattagtcataattccctgtagccagagcttccacttttccttgcgttctgattttgatgctatcttatagattaccctcctaattacaactcactgcttacctggttctccaggaatcatagcatagttttttgagtactctgtctcacttgcctggtcaggacacactacctcactttctattctaaccatttctcaatgccgaggactcatatctcagactcaagacagttatattgttttatttttaaagtcactaagatatacccatatcttggtattccataagcaagaaggaagtgagatgagaaagtggttgcaaccacagtgttaaaaatatggactggaaacttgtctatttgcagatggtattagatttctattgctgctgtaataaattaccacaagtttagtggcctaaaacaacacaaagttctcgtcttacggttcagtaggttagaagtctgacatgggtcttactagaacaaactcaaggtgaggctgaactcaacagggctgaattcctttctgaagctctaggaagagtccatttccttgccttttctaaattttagaggctgcccacattcctcagtgtgtggccccctttttccatcttcaaaaccggcaacgtctaatctctctggcccttttttccatgctgtatctctgatcacagcgggacagattttctgctttaaaggaccaatgtgattagattggacccaccaggaaagtctcccatctcaaagtctataatgttaatcatgcctgcaaagtctcttttctcatggaaggtaacatatgtacaatttctgaggttcagatgtagacatccttgggggaccattattctgccttccacaaagatattttctaaaccattgagaacagatgagagtctcatatccactaacaagagccattttgatatgcaacacagcaacccaattgacaaggaagtcctcagagatagtgtagactgtgatactcttcatctttaattctataggttttacctgcgtagtgtctgacctgaaagtgacaaagtttcccacaccttgctagatattcccacacattcctatttagcccatctagacattagaagggaagctttcctatttatgattcctatttaattggagtgaatggatttctgtcatttcctgttgttccttccatagccttatgattgtgtggtaatttgaaatctagacctttttcttttcttttttttgagatggagtcttgctctgtcacccaggctggagtgcagtggcgctatctctgctcactgcaacctccgcctcccaggttcaagcgattctcctgcctcagcctcccaagtagctgggattagaggtgcccaccaccacgccgggctaattttcatatttttagtagagatgtggtttcgccatgttggccaggctgacttgaactcctgaccttgtgatccgcccgcctcagcctcccaaagtgctgtgattacaaatgtgagccactgtgcccggcccaatctagacctttttctaagttagttataaaattttacatttttccctccttgcaaatttgttcccatttgaagaaccatctgcaagaagaagaatacataccattcaccaaaccttctatccgttgggtctatcagagaattagtattggtggtgtcttctagtcctcttgcagattaacaggttatccacttgacctgattatccatgacatcaatttggtgtatcctaaacttcatcagagcagaatattcctcagaaggaatatcatgtcaggtagcttttcagcactaagcctataaatatcctgcctgtgtaggcacatgggagtcaatcctgagaaagcagctcattgaggcaaaaaggggagatttttagctgaatcagacaattactcaataagtctgctttgtggatgtttgtgtctcccccaaaattcatatgttgaaagctaattcctaatgcaataatattaagaggtgagacctttaggaggtgattaggctctaccctcatgactgggattgatgcatgtataaaagaggcccaagggagtttccaacaagtgctgggctatctgctgttagctagcacttaagatgtcttacctgtaaagtgtctttcactataattagtctttctgactaattgtcagattcagctaacaatctcttctttttgcctcaatgagctgctttctcccatttgcctacacagaacataattgtttcatacactagaattagatcagagtagattcaggctcttcattacaaaatgctcatctctgctggatgttaatatcaaaatcagaattctagttctatcacatattgactgatataagaataagtttagtttaaaataaaaggtgagagaaagaatggaaaagtaataatatggaacatgagcagcgtctcgacttgtttctgcttcctctctttttcttactaattaaaacagataacaacaaagccctttggtcacagcccacacaatcacaagtggttccctttgttgatgtgatgtcactggaggggaaatgagcagttgacaggctgtgcaaccaagaaggcaaaatgagctcaaccatttgaataaaacatagcaggtctcccactccatgtcattgactgacataacccaccagacagtaccctttaaataggctgtctctcttttatgtagcaaataaaaaaaaaaatgtaacatgtaaatatcaggtgattcttcttcagcatctgtggttgccagaaggaatttactgccttttcattgtgtggttcaacttggtcttcaggtggtgtgccccaaaatccacaattagtgggatccagtggtgctgtggatgtttgtgccccccccccaattatatgttgaaagctaatccctaatgcaataatattaaaaagtgagacctttaggagttgattaggctctgccctcatgaatgggattgatgcctgcgtaaaagaggcccaagggagtttgttagaccccccacttccgccctgtgatgacacagcaaaaagtgtaatccgtgaagcagagagctcacgccagacattgaatctgctgtcacattaatcttggacttcctagcctccagaactatgagatataaatttttgttctttataagccaccgactttgtggtattttttgttataacaacttaaatggaccaacacaagtgatgatgtttctagagtctgtgtatgtgcatgtgcctaagtattttgccaatttagcgttaatgagtacagcaatgccaacaatggatccattctttgcctctcctattaccgcaggtctccttttcacagatcagtatagataagggtagtagagataaatattacgaggttatctgttagtgcctgttcaatcaactcttgattttacagtagtcttcctgtgtaccatgacccagacatcttataaaagcaaaacacaaattgcagttttaaaatgctattgctctgcaccattattttcctcttcccactaatttgcttgcgattcaatgtgttttctagcatctctcatgtcttgggttcttggccctcatatttccctttggattgcttcattttggtggattttgggaattcccccttggctaataaaaccttggttattcctttctgttctgctgcctagatgactattccccattccaaactttaaccctgtggaaccccacccccacacaggccatctatagacctttgttcttcctaacattttcaacagggcaatgaagtgtttcataaatatttggggttttatggaaaaaaaatgctctaaggcagcttaaagctattcttcaaaataagaaaagtattctatattttaaacatgtatatagtcatcttctttactggggaattaatggagtactctaagctattgcccctcccactctcttctcttcagctacccaaagtgatgatgtggaacttccagattttctcctgcaagttcatgctttatttattccattatgaggtccacatcaaattatattaccattcctgggattctggagttcagatctttggaaaatcacagtgtcaacagaaattataagataaaggcacttatatatgaggaatgatcccttgccctgcatttacagattcagatcaaaaaccaatgcccacatattttatctctagcttttactaaacagtagagtccgtgacttcattcacagtaggtgattgatacatttcgacaaaagtattttgcaaagacgcttcctgcagcatcaacagtaaaagagatactgaggtaggtgctatatgtatcttctggatacaaatttccaccaaaaaaaatttcatcttagcacatatctttgacttatggtgttcaattttaaatataactggcagttttgataaaatgcattcctttccattgtttctgttacaaagaatgcaattttaaggttttctgtttttgtaaattggagcggtggatacaacagttaccacccccacacatacacttctctaacacatacatatatacacacagttttaacattcccaattctttaaaaaattatctttgatcaaattattgtttatatgatgtaaatgccttggacactactgcctgtcagtgatgcgagtcagttcttctattccttttattggctcctcagagatttctggaagtccatctataatagaatcattatttcataatgataacatattttaaaaactcatggtttcagaaacatgagcaaattgccttgtaaaagcctacattgagggagttgtgcagactttaaaacacctcagcttctcactgcacattggatatggttgagtattgcaaatacagccatatttatccatgctatctagcattagacagtccttatcatcaagtgatctgagggcctccttcatcagcttcccttggaatgcttgctatcaaagtactttcctgagcccgctacagatttaacaaaccagagtctctgtgcacccagagaagggagtttgctccagtgattttcgtgcacactaaggttggagaaccattgtccctcagagccattagaaattcagcttgcatcagtctagagttctacaagaggcaatcacaacaacatgctatctacgaaaatcctatatttccatccctgactcagaatctataaatttcagtttaatttccactaaatgtattatcccgggaaaaagggcaggaagtaattatggaaaaaccattgaaacgtaagcatggtgagcagatagtatgaatatgagtataatctgacacttttaatatctcagagaacagaggaacaatagggaaagcaggtactgaccagccccagttcacgtttgtttctgccctcttgggctgtgcaactgtgtgacttgggcaagttacatgaccttgatagtcaaaatgtgaatgacagtatgtgtatattagtgatgttgtgagaattaaatgactgatataatgtgtccaccaagatagtagacagatagtaggcccccgtgtattagttacctttcttgttttctaccactactacccaagagggaagcttctaaactctgaaggagatctgttgatagagtctaatgtgtcatccagctttgtctctgggtcatatagagatacagtttgtatgccaaaaaaaatgtagtcctctatacagttcagaaaattaccaccaatatgctttatcaaacagcagctacagtgtagtatatgccaacctcagagtgggtctcctcttaaaggttcccaagtatccagtcatgtaaatgaagactgcatctaaggagttagctgtacagagaagagtctctgagaaagcgaaatagggttatagtctcctctagtccttactttcgctttaaggaaggagaaaatagcaaagagtgaagaggcctggaaaattgcagtaaaacagagcaaataggataagagactaataaaataagtggagcacagagaaactaaattgaatgacaacacatgagaaatgtactcaagttttgactcctgatttgtgaaccagaatctgccaataacaactaccaaatagatcagcccaaatatctattagtaacccccaagaacagtgcgatgtagtagagtgacccagcaataaacaaggccccatctctgccttctagtgttttacagactaggaggaagcctccacaaatttggcacagttaatgggtagctaatcagaaaaaattaagcttatatcaatgtacttaagctgtgaagaaaaagcctcatacttcttgttaaaaataaatatagtttgattgctcaaagagatcccagtccacagattaccacagtaaataattgcacgcccatctcttttgcaaagcacaaagcaacctgctccacgcgcctcagatgcctttctgaatcaccacagagggagacttttaatcatttcaacaaccagagcaccagctttgttctcaaacaatgctggaaggtttctcacacctctactatccatagtattataatttttcatttttcataggcaggggttttgttttatttggttggtgttgtcatatcccagaaacgaaacaggcctgcaaaatcaatgccacacgtacaactatgtatatattctcccctgtaaatctccattagcttgattgggactccatagtggctggaggtattgcctgcatctgcctttcattcttagtttgggcaaaatgagtggtgaatgactcttatacctgccttttaaaattggggatctcagatgagccctggctctaccactaattgcatggaactacttggtaagcagcatcactgaggcatcagcatcccatcatatttatttctagggaagatgacaaattatggccaaattagcatcgatatgaacaagtttgtagaagggtcaaaatataaatacaatatacaaataactacagcagtaatgtttttaatcactacattttcaaaaatattctaccgaaaagggtgattaacaaattattattatgttaacctagaaaaagaacataatcagtatataatcactaagaagacattaggcacatttaaataagtaggtgtttgcatgttaatacacacgtactcttagctcaggaacatgatccattaaccgatagaacgagtaagatgttagctaattggtgagttcttgcagtgagaaatgtctaatgtgagtccctggtacctgtgattttcaaaattatttaaacaggaatcaaaactgttttaataatttttgaaagcattcccatgctttagaattttggtttaaggcttagaccaaaatcatcatggaaaaaatgtgtgtctagtgctgaatcactttgacttgtattagaatgtcagctccaagaagacagacatttttgtcaatttttaatcatcaatgtacccacagtgtttacaagagtatctggtacactgtagggttattagcaaatattcacaaaataaacaaataaataatacttacctgtttcattacagtttctctgccagaattgtaatcattggtcaagtttgatagtggacatgggcctctttcttgggaagtaataacaataggaagatatggtactgaatgctagcttatgggaggtgtgggttaagaggtctcagggatgccctgtcttataaagagctctgcacaaacttaagcttaaactaactggaaaattaggacagccatctctgtcatttctctagcgtcttctaccctctattgctttccagatgcaactcaggggactctccttcccattttcctggccctttgctttctttattgggaactagttaccttcaattctccccctttgggtttatatgcattttagattattatggttattcttcttgtaacctcatttgcgtggtagatgcaaaacagaatttgagacattgccatgaacaaaaatggagccaattatttgtatttacatacttttctgaagtctattcatcagattttctgattcttagtgaggacttacttaggattattcagatgtggtcaagacaaaagcaatgaaataatcatctgaggttttgtattatctacagatataattctttatatttgctaaataacaaaaggaaatatttttctcttgttctctctgaatgaagggcaattgtgctgtttttctgtcactgtctataattttacttctaagaaatggcatgaaggtatatcagttacataagagggcttttatttgtcctttttggtattttttagtgtttggtttaatgattaaaatatattgtatctcttagatagttaactatacacttaccatatgacccagcaaccttacttctgggcatttaccaaagagaaatgaaaatctatgctcacacaaaaacctgcacatgaatgtttatagcagccttattcatgattgccaaataacttaaaaaagcagcctacatagagttcattgggtgaatggataaaaaccaactgcgatacagacatacaatggaatagtacacagcagtaaacaccaaagcagactcttgatatgcacacaacatggatagatctcaaagacattaggatgagtgaaacgatctggtctgaaaaggttacacactgtataattccatttatatgacattcaggaaaagataaaactatagtaatagagaacagaacagtggttgcctgggattaggagtagggagagaatgccacttcaaaggaataataggattaagactttgggggtgatgaaactgttctgtaacctgattggggtgttggggtggtagttttatatatgtgtgtgtgtgtgtgtgtgtgtgtgtgtgtgtgtgtgtatatatatatatataatatttgtgtacatgtgtatctgcatgtatttgaacatatatacaactgtataccaagagaaaaaaaggtaatttcccagtatgaaaattttaaaagtaaaatttaaaatatatcaaaaatatcatattgttccttataaatctataagcatagagaaaaagctggaagggtactcaagaaacgttatcatctgtgtggagggacttcaaaataagaatctatttcttttgtctttggaaaaaaaagctatttccgttttaaaaatatcgtgaagtcttttgtttagaattggtaaaggtgcttttctaaaaacgctcattttcttgtagcttttggttaataaaaatactcaaattattactgattatttttatacagtattttttctggcagtattaacagtatttgtatatggtgagtgttatattacttctgccaagcttgaaaacagagatgacaagttccgtaagtgtaaaaaaataaatgaaattaatagtttcgtgcctaagagcctctctttgcatatgagattagtacactgttctcatgcttattttgtattataattcacttcttcagaaagctcactttattccattcagttgcaaagcttggatggttggtatgcctataataaatttagaaaattaagttattactgcagtgaagttttcaaaactccatccactcacaggtatttcagttataattttgataatggagaagatggaaagatagatactatcaatattttttcctttgctacatttattcccttatgccttaaaaacgagggcatgatatgatattccatatgctaacgtgtgtatatgtaaaagaaagagaaaaaggaacttgctctatactttaatttcagaatatggctacctttgcttatgttagaatgtcagcaacagaaaattaaatagcccatataattaatgcttgtcttttattccagagtaagtttctttctgtgttttgcacatagtgtaacacaagtttgttgctgttgcttttttcattgagaaatctttaaaatgatcatgaagtgtgcaagtcaaagtaaaaacaataaaacgaggtattcaagtagatactgagaggtaaatgaattatgttcgttttatggcaacatccaaatattttgtgtttccattttatgtcaaaagttaagctttagctggaataaaaaatttcctctcttggtaaaatcagttgacttagcagttttatgcaagaactgaagtattcaatcaacatttttttttccatcaaacttcccttttgacaggaaattctgtgtctgattctttttttctttaaactgcattcaaaagaataataaaagagcaccacatgtcctctttgctgaaggagtttttaaagagataccacaataattattttcttgcttggaagctacctttattaagaggccaattttatactggaatctactattaaaattatgtgactaatgtttcattatgaatcatgatcacaaacagagtcattatgtatgggagacctgagaaatgttcgccaaccacattcaaaaatagatatttgtgtgtgttccagttacattttatttgaaagatcaccttcctttttttcttccaaatattccctttccccctcccttgtggtcctcctcacatctgagctccttttcttttcacagatggtgatactctttgaggtcaggtacctatgacctggagtgtttcttgaagcacttccaatattcggttctactttttcaatactcatgacagcacgcagtctaaggcaaaacagaagtgagggttgattgatcataaatatagctgacaccaccaagctgtcagggagcaggacactgaattgatcaaattttaaaagtggaggatgtgtggagccaaaaggaggtcgccttattttggagtcatcagctgagggctaagaaaagaaaattctggaattctgctctgtcaggatatgggatgggcttttagaagaaaataaggaaactgatttcattgcaacatgacttttggcagttgttttaccttaccttttgctaaaatgtcatccccgcacccccctcatgaccctttactattctccttctctttatttttaattttgtaaattttaatttttgtggtgacatagtaggtatatatatttgaggggtacatgagatgttttgatacaggcatgcaatgtgaaataagcacatcatggagaatggggtatccatcccctcaaacatttatcctgtgagttacaaacaaacaactcgattacactcttaaaggtattttaagttattttttacctcagaaatctctggttcatattatcagagacttaataatatttattgatcagaatttaacatttgaataatttattcttttcttatatgtacagtagtgattgggtgggaagagggctgagttcaaatatttactctcccacaagctacttggcaacttaggtagttggaacctcatgatccaagctctgaaatctttggaaactacattgtaagagacaattggttctatagagggaaacccttgcaaaagttacatgtgctctactgatatatcaaatgtatgtgtgtatgtgtgtgtgtatagtagaactgatggtagattatttcaattatatagcattaatgacaggtggactcaatttattttctctaagcagctgaaaattctcaccaagaaacagccttcctgtattcaccacctttatttgaagttgagaaataaaatgttgccaagtatatccagggtcatcccatttttctaaacacaagttttctctgcactatgacactcacattactgctgctaacatgacgagcttcagatattatcaggaggcattttgtatagtagttaatagtataagttcgggtactagtcctggattcaaattttgggttggctactatccagcttataatcctggataaattatttaattgctctcagtttcaattcctcatcttccataaactggaataatactagtactgacatccagggttgtgaagagaataatctacatcaaatgtcaacagtcattttctgtaacagaccagacagcaaatattttaggttttacaggccatataatatagtgtctttcacaactactcaactgtgcctttatagtataaaggtggacctatacaatacataaacaagtgggcatggctgtgtttcaataaaactttatttacaaaaacaggcaggaagactgatttagcccactggccctagttggcaaacctctggtctatattaatgcttaacacagttctaaacattaattttaattaatgtaaattaaatgttattagttctgtggcatacatttcaacgtatgccattattcaagaatatgtcacaatcatacaggccatactgtatttctccagaaactaaaattactatatcctaaaggaaactaccatggtttgaagatttgtttgtgagaaattctgcagtagcatctggtgatctggtgagagggacataataatcagtaaatagtttgcagtaccttcttatcaactaaatagatgaacgatgctataaaaatgaaacaaaagtgacttaatgaaatcttcagtaacgtagggtcacacatttattcattcttcaaagtagttatcctttcactataatttccttcctagattttgctaaacatatacaactggtagaagcctaatgtgctgttcctgtaacattatattcctgttccttgacttcctgatataatgaagctgattatattccgtgtttgataatgttcatcctattaggattgggaaatccattgaccaccgagcacaaccttatgttcatgttcttatcattagcaccactccagctatggagctgtcagcattttcagcctaaatgctgctttcaggggcctgcaattcagtcataaaaattagctgcaggcagaaacttgatatatgaagtccagatccaagagagaattttattacatttttaacacagagagagaagtacattagaccattataaaaaaacatacaaattagtgtagtgaacttgctctgcatccttttctgttctgacgtaatttaagattgcattcatatctgcccccttcgttttccatgtatccatgaaggaatcttacggatttccagtgccaggtgactttacgacaagttcccttaaggttacatttaagattggaacagagcagcttgagtctctatttgtcaatgggaaaaagattttccagccttttatgaattcaaaattaattagaataaattttctgccataatgcagcaacacagggtatgacctgcatcaggcttcatgttttatgattgagttttaagaactggcttgtgtgcaaagacttttctttgacgtgagattgaattaaggaaacttaattaacattttctaattaaatactgcattgtgaactcaatcgcattgtactctgcaactatgatgagattgttctgtctttatttaaataaacaagatggctcacagggttgagagcttggttgataaccatccctttctttcctcagttgtcacctctgcttttcagaaatattattagccactcacctaactgcaggaatttggtagacacacatttctcaaaaatgctcaaggatactaaaaatgatacctgatctcatgattgacgagagtagtagtctacccatttaatacctaattccagttcattctattcattcgagacaaaccctatttttattccctttcaccttattttctccatggaatatgtgatgtataacatgtatcatgtaatacacaataggtagcgtataatatgtgatttccagtgaccaccatggtgttcaatttaatagttaatgtgccatcctcatcttacttgccccgagagctgcactggacaaagtacacaccatttctccatgatactcatcttcccatggctcccaggacaccacattctcttagtttccctcccaccattctggtcactccctctcactcttttttgctggttagtcctcttccccctagtctcctaatattgcagtgccccagggcttaatccttggtcatcttctctactctccctactctcattccactgatgagctcatcctatctatatgccagtgcctccttaatgtatatactctgccctgacatttctcaaatcttgcatacctaactgtctatccgtctctgctggaatagacactccaaactccatatgttcaaaatcgagttcctgatcttttcctgcggacctgcaccacccacagccttctctgtctcagggacggtaactccagttgtcagttgctgaggccagaatcttagaaataatccttgactttttattctctcactctttacatccaatctgtcaggaaattttcatgcctctcacttgaaatttatccagcatctaaccacttatcacttctccaactcttatcaacctggtataaggcacttaccacagtttgttgctccaaagctctctgttttacattgtcagcaacagtccttacaatgatctacaaggcccaatctgggtgaattcttcatccccccgtcttagcatgtctcctcctctctgactttcttatgccacaacagccccactggccttcttgctgttcttctgacatgccaagcacacttccttcttagacctttgtactcactgcctgcaatgaatgcctgcaataacacatcctcctggctaactccctcacctccaagttttttctcaaatgtcaccatttcagtgagtcctatttcgatttctatttaaaattgcaaacctattctactgccagcatttctgaggtctaccttttctcctttccccatatatcttatcacctttgaacagattatctaacttttgtctgtctgtctaccccttatcatttgcccaccacattaggatgcaagtcccatgggggcggaaagttttgctttgttctttcgtacatcccaagcactgagagtagtgcctggcacatagaagtaactcagtgaacatcagaactattaaaagcatatacaatcagacgggcatggtggctcatgcctgtaatcccagaactttaggaggctgaggcaggagaatctcttgaggccaggacttcaagaccagcatggacaacatagtgagaccctgtctctacaaaaaatgaaaaaataaaaaaatcagctgagtgtggtggcatgcacccgtagtccgagctactcgggaagctgaggcgggaggttcacttgagcccaggtgttcgaggatgcagggaactatgagttcaccactgcactccagcctaggtgacagagcaagaccctgtctcaaaaaaacgcatatgtaatcattgaagaaaattaaattataactatgaaaattcaagcagtcacaatatagtgcaaaactgaatggtttattaaagatgtttaatttgaaggagattttttacaagtaacatttgttttaaattattcttattaacattttaaaagattgattttgcatgatacaagaaggatggtggcttcctatattacagaagtaatattttagagaagtaatagttccagtcattgccacagagttctaaataaaatttgcacatggaaaattaagcatgtaaagcaattgcatcctcatgatttagctaagaaaatgtccaaaacagttaaggtcagtcgtagatttaactcagtgtttcaaaaccatttgattcattggtaccaaaagcaagcgttttacatttttctccaaatctttggatgttgttatttcttctttaagcaccataaatttttagctatgcatgcttactagaagtaagcaataagcaataacttattccttttcatctgtggcttatagaacctcttgctttgtgcatatgttttgcccctctatttcactccagaggttttgatcatatcaagtttcacttaataaagatgagtagagggcaaaaatcagtagtaactttggggaaaagtagaagttccccttaggcattgaattataatcaagtgaggaaaagctattattgatactcattcagaatttcatattagatcattgaaaatctttaggaataatgattgcggagtcaccgctaataacttaatgacaattgaatatgttaaaggctttgaaaaagataaaatagatgtagatgacaactcctgactcagatgactatagtaatttttcataattaccattcacagaatacaatttagatagaaataagagcaagagttaaatgcaatacggagtagctctaataggacctagacatcagggttaatttgaaaattatagttcctaaagtaattgtgttgcagaagcctatcatacaaaatataaaccatgaaataaaatttttatgaacttcttactaaagctgtttttatacccttgttttgatgatttacatttctaatttcacaactttagcccttagttgagccctaagcaaatttatgaaaacatatttcttattagagtacttgaaatcccctgtatgttactaatcccaaccaatgaataagaatttccattctgcaataaatatcattgctatcccataacctatgtttcacttgtacaagaaaatacttcttcagcacaaagaaggaatgattaattcttaaaatattaagaaaacagcctaataaagtctctcaaattccacttgtaaaagcagaaaaaatattagagtaaaatcgccacagattgtctcctcaaatcataggaacatgaaaattggaaactttcagcaaaatttatttttaacattgttcaactgttttgtatagaacatttaacgttaagaagcaattttgtggtttgaactatttgcatgataatttctggtgtggaagatgccttagagctgtgttgcttcaacttttcacatcagcacagtaacagtggggccaatttggtctctttatgtatatttcaacattaaagttatttttagacaaatctaccattggaagattattgttgcattggtggtggtgagtgagattcagctatgtcaaatctctccatttaaaaaaatgaggctgtcacatatttcaggacttctctgatgaggtgtcacagtattttgatttaacagactttgtataactatgtggatacaatagcaaaagtttattttcatttttttttttgtaaattgttttgagctaggtcagaatgatttctaagcatacacacgctaaaacaatgctaagacatagaaaacagcaaatttttcaggctattggtagatagtttaataagttcgtcctcttttgagaggtctagtcacctgtgtctagtgttggatggaaaggggcttggatccactggttagtcttccttattgtctcagagaaggagaaaagggctttatcgtgaagaaaaatgactgatggagctctatatacacaatagtataatttgaatttaataatcaactaatagtaccaaacaatttataacccccataaactcctaacacccgatcttcattttcactgtaataattctgtcgcaatacaaagtgttcatagttttttcttgtatttgtcaataagatggctcaattttggatgagaatttcaaccactgttgtttacagaagttaggattttttttttaccaccatgttgagctccttgaaaaaattaaaggtaaactttttgaggtgaggtagcctttgtgaataacattgcaactgaggaatttttttttttttttgagacagagtcttgctctgttgcccaggctggagtgcagtggcatgatctcggctcaccgcaacctctgcctcccgggttcaagcaattctcctgcctcagcttcctgagtagctaggattacaggtgcccgccaccacacttggctaatttttgtatttttagtagagatgtggtttcactttgttggttaggctggtctcaaactcctgacctcaggtgattctcccgcctcagcctcccaaagtgctggggttacagatgtaagccaccatgtctggccacaactgaagaatttgaggtcaaaatagtcctaatgaaggctatcattcttcagctctgcctttcatgaccctttcagtgtacatattcatctggttatattttcagtcaatttcttggctcacccaagaaaaaaatgcatatcttgttgaaaaattcctcgccaactattttccatcaaacagtttttcataggtcttcacagggagcgttattttaaatactgagactccaaggcaaatgaaacaaccaattcattatgctataataaaaccataagaaaaataacagaggtaatctgaatcgagtgactggttgttccacagtgtttttaaaagacgcttcttgttagtgttagtaaataaaggtgtctatgtttttcagcttagctacctctttttggctcaaatcagattctactatccagtttttaatcaaattttctcttatctataattaacccttcaaaactaaactttaaagttcaacttgtttcctttttatgactagctgaaaattttttaattgtaaaagaaaaatgcttataattttttctatatgcatatgattgattttaaaatgtcattgcaaaaacgatggcctcatggcatataggttcatgtttttttgtgtgccagacactaaaattgaggctcctttatattattaaattgaaactcatgtttgaaataaactaaatacagcctataaggtttagattcactgcagtttactgctgattggaatacttttggtatcgagtttaatatctgacacaaactttcatcatttgtgatattcccttctaatttatcttgcatatttccaccagtttgaaatttgcacttcaaacttcctatttttattcatgacccatttcaaaatatgatatattaattatcctttactgtaaatatatgtactcaaaggggtttggtaataccctctttgtaataagtatgaaaagaagtgtccaataatatggattgattaaataaatataatccatataatactctgtagctacgggaatgaaaaaaatagagttacttgtactgatagaattttgtgctttttagaagatatatgtgtatgtgcgtccatacatacatgtgtgtatactgtatatgtgcgtatttctatatattcatgtacatatgcatatgtttgtcatgtttgtctattattatacacacgtgttgtttatatatgtagtattagccaagaaacatacagaaaaaactgtttccatggttacctctgagctctggggagtgaaaccaaagcacagaatgtgggtaggagctctttactcttcatcatctatcctttttaactgtttcaattttttttttactatgaccatttgatttagtatgaaatttgttatatatatatacacatacatatgatatacattcatacatgttgtgtacatttatatcatatatatattacattatatatgtatctatatacaatgtagtagctatcttcaaagaagattttttataactaaagataagaatgttaaaagtgaaggaaaacctcaaggcccaaataactttgtttgtagtatttaaattctgctttttctttctattctctcactgtctattcccttcatcacttaaattcattcccactaaaaatgactcacggacatagtttggaactagttgccacatcacctcaaagttaagggcagcagcttctctatttacagctgggaaaacttgtaactaagagggaggccatagctttagttaaatcggcatccaaggaaacaaaataccagaaattaacaatggttgcaaaatggagtcctagcctaatccctctcctttctaattactccctaattgtttcttaaccatgtgccgccaggctgcagtggttggggtatggagagtgaagaactttttgaataaggcaattcttactctggaaggactaacgaagaacctgattgtaactaaaatgagggaacagttcctactatttccatcaaattcattctgcccaaggaaaaagatgatgatttgattttaattatgctaacagcatttcaatagcctccggagaaaatgcctgctttccaaaatgcagatcactaaattatactgtgcctcctagcaactcctactactgagaattcaaagcttatctcaactttactttgttttaaccatcctaagatttcagtccacagctttcccataggctctacctgccttttagtgtctagaacacactctcacggcatctgggtcttcaaacccacacagttcctgtgagctattcaagataggtcaggttccagctgaggtcaggcattgtgatcactcaagttaaccctcctctaaaccctacctctagtgtcctaaatttgctttttgtctcagcagataaaacccagaggttcccaaacctgctgtgcatctgagtcatgaggaaagtttgtgaaatagattcttggtttctcagctacactaatacacggcaaggcttgctatcctttcttccagttcactgcttctgggtcctgcatgctggagcaccaccagtgctgcctcacctctggcctcctcctgacaaaggggtctctacactctgcactctgtcatctgtaaccagccttcttaggcacaagctgccttctattttttaactcccagtttcgtttttatgaactattcaaatcaaataattaagaataacatcaatgatgccagcaccagtagaataaggcacacctttgctttaggtcagatttccttgttcctctgtttcctgatgaaggcctatgcttctggactttcccttgattcaagatgagtgttctgcttttccaaatggccatcagcagggactaatggtggtcactattagtcttcactgacaggctttttagtccaaacttggagacatggctattgagcccagagttctcctcacaggcactgaggcacaggattctatgagcctcctctaataggtttcattcacagggataatgacatggatggatatggttatattcatgtaggttttagcaagaaagatgctgtccactgagagctacctgaaagattatgatacacactcttggaaaagaataagaggagcagattaaaataaaaatctttgcttaacagtttgagttggatggcttgatgaattgcaacacctaggaaaagaaatcttcctaggttatcttacagttatgatttttttaagtataaaggagatgagaacaataccaatgtaattcatcttaaaagactttaacctgtactaaagatttgtgaaattcttcattaattatgattgactattaataccatctcaaagattttgctagacctagaaaggctttgttaaataattttccatgtaccccatactctcacagatttaaaacctaacactgggagatagtctatcaggcaaaattatgaacttatatattgatgtaggcatagttgctcataggttccaaaagttaatatatacatttccaaaagttaaatataacattgtggttttgattacatatcacgttttcctttcccgctcaaatgaagttttaacatgattgcctagatttggtttcaaatttacctgccttagaaactgtcactcaaatgtacaattactttttcaatgttaagaagaatatgttatgataagaggttcctaaagaaagcatttcatagttctctggcattgaattttttttatttgttaccttgtttacttgtgtgtgaacgagcataaagtgaaccctcagaggacaagaaaaaatatcaggtatttctttatggatttaatctctgaaaattttccatcatcactaatgatgtcccaggagtccttgaagctaaaataacaagatatacaatttacacatttttatttagatgcactcattgtttgcaaataactttgcaatctgataaagaggcaaaaagataaactataggtataataaacttgaataaatggatagaatttagaatgtatctgggggatatatcaagggtctgtttggcaacttgggaagatgattggagaaaaggacagaaatacttgaggaaatctttctgcatggactggatcaagtctaaattccaaaatactgtccagccatggaatggcaggttagatgacagcttagagcgaggattggaaatgggaaacaatgtgaggatggcaaaagagggtatgtctcaagatgagattcaccagagcagagcaaagcagtgaagagccttcacttcattggacagcacttgctctttctccctttacatagattaaccttgagtttagcaatgcttatggagactgctagagaatgaagggaaacaagacacaatctgttaagtaaagaagcctagaaacattgggtatgtggaaatataacatgatggtgctaacagtcattatggtgactctcatttgtagaagactagttctgtttcattaagagataggtttcagcttgtcacctagtagatcttatcttaatcatggctgtgtatgttgactcacataccatttttactagtatgcacatccaccgtttactgagctgttgctctgtgctaacttacagtgtgctaagagctttatatactgtattcatacagttaatccctataacgaacctaggagtgaaatttttcacacccagttttgcaaatgagaaaattaaaatatcagaataagtgacataactttcttaaggtcaaggagataataaaagataggcttctattttgacatagatttagctgtctcaggggcctaaattcgagccaccgcatttatgttttagaatagcgattgcaaattgttgactggagcaccaaaatcagcctggggacctgctttactgattctacatactatgttttcagacaatctgaatgtgcatttttatggaggggagtgttaactggagtcaccgtgcatcattgttttaaatcatcttgacgtttaagatttcagtttttcatttaaggttacaggttgaataatatttctccctactttatcaaaatatatatcatatatatgtataaaataaactagcacaacagttatttaaagacagttcaattgtttgtactgagatatacaaacagaaacatttgggagaaatattacaatattcgtaaagaagccagggacattggttttgcaatattgaggtgacaagtttccaaaaattaattctatactgatttcagatcctattttccatgaatagacacagccagagggattcccttctgtaatcctcatccgtatgcctctaccaaccaattaattgctcattactgcatcaacataagtgtgaatttgttgacagagagacatttaagaaagaggttgtaaatatgtcccaatggtcctacgtactctggaatgtgggggaaaccataatcacagttaattcaatgtcaaatttcttattcaaatatgtatttccagttacggtgataatttttcattcatgctcgattgtgatgatttttgcttttattttatgttattctccattacggaacttcattttgttttacacaaaatagttaatataatacttcgcagtaagggcattttgaaagaacagtggcttaaaaacaaaatttatctttgtgtttcctacgaggtggtaagccagttagtattcaacaagtgtttataaaattatttcattttcttaaaagcctataataaagatattaactggagaaagaacgttgaaaattcagatgagatgaccagtggttttaatacagaagagacagttttcatatttttagcacatagaaaaaattgtaaaatgtgtttgctaaattccatctgaacattatcgtaagaaaacctcacaaatattttaatttcttaagtaaaatagcttatttcatttatgccctttactactttattttcactagataaatcatcaacgttttacttactttttcaaaaatcccagtagaacaatcatgtttgttttgacaaactctagaaggtttttatttctattaatttaaatagacaaaaagaagacacttgaaagcagcacgaaatccccagcacctttttacgagattataacttgtgtataaaagtaattaacattttctagtatcatattttaaccagatcagagattcttaacccaggattcttggatctacaaattaattttaaatggccttaaaattgtacacacaaaaaatattttcatggggtggggaagggggacaagggctctaccattcatctgttcttttttttatttttgagacggagtcttgctctaccacccaggctggagtgcagtggcatgatctcagctcactgcaacctctgcctcccaggttcaagcaattctcctgtcagcctcctgagtagctaggactacaggcacccacaatgcccggctaatttttgtattttcagtagagacggggtttcaccatattggccaggctggtctcgaactcctgacctcaggtgatccacccacctcggcctcccaaagtgctgggattacaggagtgagccaccgcgcccggccccattcatctgttctttaagagcgtttgtaactaaaaaattttaagtcagatttggaggaagaaaattagaggttttggggaggataagtcttgttcactgaagagtccctttcacataatttaaataagagctattgtgtatgaagctgggcacagtggctcatgcctgtaatcccaacactttgggaggctgaggcgggtggatcactttaggtcaggagttcaagaccagcctggccaacatggtgaaacctcatctatactaaaaatacaaaaattagccggggtgtggtggcacatgcctgtaatcccagctacttgggaggctgaggcaggagaattgcttggaggtggaggttgcagtgagcaagatcgcaccactgcaccactgcactgcagcctgggctaccgagcgagactccgtctcaaagaaaaaaagctattgtatacgaattgggctgctattatttattctcagtatttaatagtgaagaaatgtcttttctaatcatgcttatttatccattcactttctgataagcatttattgagtgcttaatgaatgctagatattgtttaccaagataggaactcagaaggttgagcaatctggggagaaatatgactaatcaaattgctgacacattgagtgtgagatgcttgtgggatatccaaatggagatgtccatggagggcagaggtccaagccaaagacttagatttgaaggtcagtaaatatgggtggtaaagtcattaaagtgtttgatgtaggtaagcccattcttgcatgtatagtgtgagtagaggatgaatgagagaaacagccaacattccctaggtgcgtggagggagtaccttccagagaggctggaaagtggttgtaaaaaaagccagcagagaaagacttccaaaatgagggaagagtaagctataccaagaatgtagaaagatctagtaaaataaagacataaccattcaaactgggaatcaattttagtggaaggctatcagtggacgtcagactgcagttagtagatgggaaacgactttcagtgtgctgtatgtttaaggaaatgattgattgggagataaagtcagaaaggacctcattacttagcacctggtatgtgatattttataaataccaagttaatggctttaactgggaaataataaaatcattttcctcctaatcccagaagacaatccactgagagaatgggatacttaaccaggggagaagacagtgataactttggcataacgtgtatcattcagagttcaaccagagaagtagagcagtagggtattatatatgtatcctattaggtgtgtgcatgtgtggagtttgtgtgtatacacatacatatagatagatacacatatattttacagagaatcggtttacaccattatagatctggctaagcagtctccacaaagctgtctcttcatctaatatcagagcctgaagttcacaggcaggcagtcaggtgggaagatcacaagcaggcttgaattccactaggatagactgaaacctgtgttttttgttgttagttgttgttgcctctgaccacggcagtaagaatgagcacacatacctctggcccagaaatcagacactgaaggaagatccaggggggaagagagcaatcccaggtccaaatgatgctttatgtcaatgaggcaagtcagcataccagcagcagtatgcatgtgtgcacacacatatgcatgcacatacacacatactgcaaaatggcaactgccttcctaacatcctccaactagtgtgaaagaatttatcgtgtagcctaccctaactggacacatgcaagaaaatggaattctggtaaatgtagtttgacctagcaagttggcacattacagagccaatacaatgcgtactttcagagatggcaagccttagaggctactagagtaggggttctgggtaatcattgtgcttcatgaaggtcctgtcacttggtagataagtgaaggaagttatgtagaaatctgagggtgggaccatgaagatcagcttgtttatcctctcagttgttctaagggcattgctgccatccctgttaacaaggggattaggaaataactgattcaatttgcctctctactacttccaccattcttaataataaaaagaaatgaccagtttctatttatttttttttcaggcaatatttttataagatgaatgatcttgattattacagtgaaaataaaatgatctctcagaatgttctgaaaacagttgtacaagtggaagttacagtgttggcttaaagaagagaacataaatactattcacacttctttagctgtactaaaagagctatagaatgtagccttatttattgttatgtaaaccagtaaaacttatccagcaagtgacaggaccttcatcctgtaccaaatccctgtttttggagtaagatgccaatggaaatagtggagctagtttaaaatcaaacatcagttcaaccaaactgatttaacattttcatttgtgttggggaagctcacggtctttaaatatcgatgagaaaggtgtctcttctaatacttgcttatgtgctgttaatgctgtactcccaaagatgatcgctaatctataatctaatctatacaactacacttttcaaaggatgtttagagtcacagacctgaacctgacttagggaaaggtgtttctccaagagcttttctgtgactacagattgttggagaaaacaggtagtgaaggaagatggcgcatgatctgctgcgctaccatgaagtagaatatatggtgatattttaaggctatatgtttacttttgcctaaattataaaagcaatatttttatattataaaaatttaaatgttgggaaataaagactcatataaaaaagataacaaagaagtaactgagatatgtcacaagttctttaaagcttcatccgtggaatcttaagaggctctctcctacttcagatgagaaagtcaggaagcatatcgtttgactaaacagtgatataaaaaatactaattaagtgacatttcagaattgcagttttgaaatgatttgctgttctgctcacaagaatcgtagttatgtttactaactttattcattttgtcttaatatttgctatagctgccgtgggcatggccacggcaaatgtaagctatcagactgaccaggttgatcacatcaatgaggaatattttcattaatccaagatggtgtttgattcagaatgcgcatcgtatcagcaacacttgccatcgaccattaaatgtgaggaattccaacagttagttagcaccaaggagttaacgatatgaaacatcatccagaactgaacaaatggctttactccttcctgtatcttgggctgtgtggaagttgtcagggtttcctggaaaagagttagatatgcttatatagattaaatatactaaagggcattccccgtaacagtcaagtaagtgttgggtaaaaggcaagtttattcatgtaactacagatagaatacgaatagtgtgaatgattccgtaagtattttagggaaagtattcatctttatgcaatgaaatatataaagtggtcattttcctaaagacaagaagacagttattttaattgacttccacaacttcccacttagagagttgctagtattaaaaaataaataaaatatcactgccatgaagattaagagtgatagtcagaaaatggacttcagaaaatgatacactttctttaggtaggaaagcagtaaagctattctcaagtgataaccttttattagatgctggcaagtctgaaatgctccttgacaatctcttttattgaacgaatcttgaggactataaacctagatcagtgccttataatccttgcataaggctgttgtgattaaaaaccaagtgaaaaacttcccaatagctcacagaagagtaatcagtctgtcttagtatttattagggtgtgtgtgtgtgtgtgtgttttaatgggatactgcttaagtatacaggccaggagtaaaggtaacaccatgagggagggtaaaggcatggaaagtcagattgggaactccaaaaagaaagaaagaattttgagggttgtcagagcttctcaagagatcacacgtttagagacaattcaaatacttttaaacaataataacaaaaaaatctactgagcctttagtttcatgatcagaatgggggatcaaagtcagaataccaggattagtttcaagtgattttaaagacaccaatattagaatggactgagacaggagatacaggttgcaaagagaaataaataacaagtcttcctcaagaatgaaaagaactctgagagacgtagctttggtcatagactagaaatgagaataacagtgaataattttttttttttttttgagatggagtctcactctgtcgcccaggctggagtgcagtggcgcgatctcggctcactgcagcctccccctcctgggttcaaatgattctcccacctcagcctcccgagttgctgggattacaggcgcctgccaccacgcctggctaatttttgtatttttagtagagacagggtttctccatgttggccaggttggtctcgaactcctgacctcaagtgatccacccacctcaacctcccaaagcgctgggattacaggcgtgagccaccacacccggccaacagtgaattttttaaatactgaaaatatctatgaatgctaccaaattctgaaactcttcctgattaactcagcacagaaaattccctctcattttgagcttcagttgttcaaactgcttccatggcagttcaaactgctatgtctccctctatcaaatggggacaacaaagccaggcttcatggtatattttaggctcagaagctgtcagaagcattttactgagccagtatggagaagagacaagcagagcaaacttctgcctgaaaaacaagcagttaacactgagtacttctaatataatggcgactaacaaaaatccttctaggcagaaaaggagaaaacacaaaacagtgagttcactgttacatcttaaataataaacaacatgcattagccatcatgatttcctgcacttgccacgttataagcttataaagcttcctaaaaatatttcattagctttgaaaactaataaatctaatgattacaatttatatttttaaaaacataagaaaagcaggtttgtgcctaagaccttgagtgtcaagaaagtttagagaggataactcattaaagtgtacagcgaatcataaaattcaatttgaattgaaccttccattttggcccaacctatccatgtaaaaaccagcaaaacaaatcattctaagtcacaagctgctgtatgtgttttagaacagatactatttactatattacccctaaataaaccaaggtctaagtaaatggtttctagcttttctctagttaagctaagttctttcttaaaaggaaactcgttctaattcatatttttcttctcgaagagggagcttatatttttctgtttctgcactttgaacatgagtattgtgggaaagtattaggggattagcaggagataaacgtggtttttgtcttcaccactaagtggatcaaattagtgggtatatggccatgattttattctgccacactatgacctgtgagacaaggtggaaaaagtagattctagaggcactgatggatacaggctaagctgggtaacaaggataccccaaaatgtaatgtctttgatcaaattgaagtatattatttctctcgataaataaaccaatagctagcagccccagaccagtcaggtgattccattcaattaagtcattcagggactcaagtcccttatatgttgttgctccccatttttttcctcgtatttctggtggaagccagttcactgatacatctgctttccagtctgcaggaaagggaaaaataaactccagggcatgcagctttatcataaaggaaatgaccaggaaattgcacacatcacttcttcatacatctcgttgacccggtctcaggcacatggccacatgtagctgcaagagaagctaagaaatgtggtctacaactgggtagccacgtgcttacctaaaattctagggactatactactaaaaggaagaaaggactaatagacactgggacacatttagtggtctctgcctcaagaggtatcagccagggtttggagatgacgtattcagcacaaaaaagataaggcagtgtttggacagggttacatgtaagttgtgattctcttgaacagacccctagtggtcactgacatttgaataaactgctaggggtatttcactttcaccaccactaatattctttactttcctcctcctttcatttttctttccgtcttgctcctccttttcatattccaattttccccccatatttttcctttttgtttcaactgctcatgatactgaggtctaaagaatttactgagtaatgagcacagatgtatgctttctttatgcatttttaatggctgatttaaatatacttggaggctaaaaatgcaataatttgctttaaatgtgtaggactctggaaagatgagaaagcactgtaagagttaaataaatcaagaaaggatttggaatagtgactatgtaattaaaagagcagaaataaaggatgtgccttatcaagatgtaatcacaaatattggaggataaaaagacctctgtattaaaacctaaagatatctgcattacaaaaaatgttcactttgtggatgacttgaaaaactttcgaaatgagtacaattataagcagatctgatgtttttgtcagaaagcaaatcacgaggtacttcttccatccactcaactcaagggtaacaatggctgtactttctgcccttcatcatcaccaggagtttctgagtagccttttagagcaaatcaatttcctggcaggtgagtaatttctactgtatagtcatcattttcccgcatcatttatctaagacccatcttctcaacactcaggtgcaacatcacaccttcccaggggtgaggtcatcaagggcatctgggtgttaaatgtttgatgttaacaagagggacaccccctcttctggctggtgtccaccgattgttctagacaccatgaacttttgtttcatgcaggtagaaaacagccatcaagagctaaaatttgagcccttacaagaatctttttactacccagcacaatgtggtaataatattcccacttctcaggcccttttccttcaagtgaataagatttcctctctattctagaggagccatgctactgcctctcttcatttgattactgtgggaaatcccccagcagcttattccaagttcactgcgcagccctctgattcctgaaaggcataatttggcctaacttgatatatatactatatatcatcacttacagtaatgtttgtcccataatagtaatactactactaataataataataattgctaacagtgagtgagcactcaccatgggtactataaatttatattaacttaattaactccaagttatttgttgttacttaaattctcttataatctattgatcaaacaattgagttgctttgttcctaaaagctacaaaaatatatagtaatgtagtataaaatctattttcataaagaaatctgacactacagctgaattatggttagcaaatttaaaattcataccttgttttcctcttgtgattttgtctccttgaaatttgagcagatgttgttatatctttcagcaatcacatcctcaactatgagcttaatataacgtacccctttcattacttttcctttcttttagaattcttagataaatctctgatttccaaagaactatctgtgctttgatattggcaactattatctgctgtaggtcctagtacttatttaggtaaaagatcttaatgaagttccaacgaacttcatttgtctccgtgtgtgtgtgtgtgtgtgtgtgtgagagagagagagagagagagacaaagaaattcttctcttttttcatttctgaataaagctttctagaagagccattcagtgtaactaatgacaaaagataaatatgttttgtaaaccactttgcttttatcttaaatggggagtcttcggcaaaacatttatctttaccatgaccgtagagtaattttaatatacatgattaatggtgcaaatgaaattaaaatccccctactattcaacatcttagttaagaacaaaatgctcactgtttcctaattgcaaagagtaaaatgtctggatgttgatgctttttaattagaggagaattttctttttaattaaaaaaagagagcttttttatttttcagtaagttagagagtgtcctctagtggagagagactctgatctcatagttttagaaatggctatatgatacccagttagaactgtgctccacttagctgattggaatctactggttgaagggaaaaagtattgtttttcctctaagacccctcaaatcatggcctagttaaaaggctgcagtgtgacaagcattgttctcattttagataggaatgattttttatgatcaattttagcatgcttccttctgaacctgttgaggttgagctgactgtgcacctttctgccaaaaaggaggcagaagcatttagtgcaatttactgtggcttttacaggtatcaactggaggcagcaagaataccattgtcttcaggactgcagacctggctgactgatatatttgatgtgtgcagatccctaggccatagcttaaatttgtttcttttattatttgaaggaaaacaaagaaacaaaattgagagacaaattaaataaaggtctctcttctccttaacttgtcgaattctaatgctaatttcctgtatttctggttaaatgtgctaagcagtcttagctctatcacttgtgtatcagagatgagaggtggaggagttttttcgatatctaaatggaagagggtacggaagagctgtggtggttggctctctgaatcacatactagaattgccttatcagaaattgcttattacagcaaattagagactgaaagaaaagaacgatagttgctcttgataacaagctaaatagcttggacttaaataaagataaaaattttattgctgattctttttttaattttaattttttaagttctgggatacatgtgcagaatgtgcaggtttgttacataggtatacatgtgccatggtggtttgctgcacccatcaacccgtcatctaggttttaagccccgcatgcattaggtatttatcctaatgctctccctccctttgcccccaaccccgacaggccccagtgtgtgatgttcccctccctattccatgtgttctcatttttcagctcacacttatcagtgagaacatgcagtgtttggttttctgttcctgtgttagtttgctgaggatgatggcttccagcttcatccatgtccctgcaaaggacatgatctcattccttttttatggctgcatagtattccatggtgtatctgtgccacattttctttttccagtctatcattgatgggcatttgggttgcttccaagtctttgctattgtaaatagtgctgcaatacacatacgtgtgcatgcatctttatagtagaatgatttataatcctttgggtgtatacccagtaatgggattgctgggtcaagcggtatttctggttctagatccttgaggaatcgccacactgtcttccacaatggttgaactaatttacactcccaccaacagagtgaaagcattcctatttctccacagcctagccagcatctattgtttcctgactacttaataatcgccattctgaatggtgtgagatggtatctcattgtggttttgatttgcatttctctaatgatcagtgataatgagcttttttcatatgtttgttgactgcataaatgtcttcttttgagaagtgtctgttcatatcctttgcccactttttgatggggttttttttttcttgtaaatttgtttaagttccttgtagattctggatattagacctttgtcagatgggtagattgaactttctcccattctgtaggttgcctgttcactctaatactagtttcttttgttgtgcagaagctctttagtttaattagatcccatttgtcaattttggctttttttgcaattgctttggtgttttagtcatgaagtctttgcccatgcctatgtcctgaatggtattgcctaggttttcttttagggtttttatggttttaggtctaacatttaagtctttctttaatccgtcttgagttgatttttgtataaaggtgtaaggaaggggtccagattcagttttctgcatatggctagccagttttcctagcaccatttattgaacagggaatcctttccccattgcttgttgctgattcttatatttgaaaaaaagggggataaggagagtgttcataaaatccttcagtaatccaacaaatgtcagagccataatgaacaataaggcaaatatattcccttttatagataattttcagaaacatgtatagtcgtgactcccacacagatggaagaatgaatacatgttaaaaaattttttgctgatgtgatatgaggggaccaagcagatgttatgaccagttcaaaggaaatatcaaagcagcagatttacacagattaaagaaatgttgagatgaattgtaaatggagacaaaattgtttttttccccaggttataggggggataggagaggtgagtcaattaaatcactatcagacaggagagaatttgtacccctatcagtgtcctacattttacagagtcaaaatatagttcaaagacagtaaaaaagcctttgggaggccgaggcaggtggatcacgaggtcaggagatcgagaccatcctggctaacacggtgaaaccccatctctactaaaatacaaacaatcagccgggcgtcgtggcgggctcctgtagtcccagctactcgggaggctgagacaggagaatggcgtgaacccgggaggcggagcttgcagtgagcccagatcgcgccactgcactccagcctgggtgatagagcgagactctgtctcaaaaaaacaaacaaacaacaaaaaaaaaaacataaaaaagcaggaatccaataatctggaagggtgtgccatagaccaatgagtagttttccaatgaaagatatttctttctacataactttgtaaatatatatatatatatatatatatatatatatatatatatatatatatatatatatatatatttctgtagcctggttgggttgccagtgacccagttttatatcctactttcttgtctacaccagctacttctctacctacaactgccattattgtgaaccctctttctctttcctcttctccagcctccctgtccttgcttcctgcttacaggacctgccctaatatttttcaattttgttgcttttctgagccccagttccactttaaacaaattccaaggtaaaaacaaattgttctggacagttaactgtaatcacttgcatgaaaaaatcacctgagggtgcttgttaaaaattcaaatccctggaactctccagacttgacttgctgaatctaaatctggtggggggtggaggtaaattttttgacaataaatttggaactcactgacttaagtaaaataagaaaaaaatgtaacatctaagccatatgactctaagctaaatgacattgtagaatatatgggagtataaaataaaaactgatatgaaagttagtggaaatatgcaagaaaaagcaaagttaatggtagcattagtaattgctagtaataactttccctaaagttcctatcacaatctatctagcactaattattttcaagttgaatatctggaatgtcaatctattaattttttaatgtccattctagatgctatgctaagtgagttttaaaattatttttcctttttaattgaaagcatacccagacacacattaaataaacacaaaaaataaaaattcataatcattctgttttttctttgtatcactttccattctactgaattttactaattataaatttaaatcttttaatcttgcacttttttgttatttctagacttcaattttaagaaattatttttcctccacatatttataaaatatatactttctcctatatagtatatttatttcatagtaatatttaactctaataaatcccacatttatttttctatattatatgaaactaatttttgtttttagaaaataatgcaattctgataactcattgcctggagttaaatctggtaccatatctgagcactacaattgatttcaaagagttgtaccactgcctgcgggataaacatgatgttgtttttttataattgttttaaaatacattttgctctttgtttagaccaacaacgtaatgtccagatctatcatcattacacttctttaggatagttgttgacaatatctacctacttaaatttctaaataaatatagattttgttgagttctacatcttattggacttttattagcattagcattacatctaaaatgtaacttgggaatggatttgtttaattgtttattgctagtataaataggatctcttctattttctaattagtaactgtagaaatcatggatgataatgatttctaaatatcatagaccataactaactacagagtttcttcttaaggctggcaaaactatgataaaaatcagtgtctcttagagaataagattaaaaaaatttaaatcacattaactatagctaaactgtaagtacattaaatttattgctacaaatcatgtagtttaaaaaaaacccctcaaatttgccagatttacaaacttaccccactatggaaaactggctttcttctgaattgccttcatcaattatttattgctgcagggttgcaataggctgaggtagatgctcttatggagtatctaatatttcatattaggcagatagtgtttcatttttaaatttcaagccttgtgcctgtaatcacagctactcaggagaggggaagaccgcttgagcccaggagttcaagaccaggctgggtaacatagcaagaccccatttcaaaaatatatatatatatatatataagcaaacttttttaataattttagaatctatgctcttaagacccacattctctcttggttttattttgcatattctcttttgagtttcttaagggtatttttgtctggacctaaagttctatccaaatatattgaaaaaaatgggtagcccctcctttgagaattaccacatagactccatttgatctataggatagtgagtcttatttttacgtgattatattttgtttaaaataactcaaactatagagaattttatattttggaataccaatacaaaagaatgttatatcaaaaggacaaatttttaaattttgctagtaagtgattacaatatatgtcttagatttgaatatttaaaataactttttaaaaagtcaaaatatagggctttttaattggttaagtatgcaatcaggttatcttcaaacaatgtttttattgaaattggttcaatatatgaagcctttatttggcaattttcatctttatgcactttccaaatgttagctagttaatctgcttaacaatattccattaaacagttgtacacattttatgttcatacactcctataaactttaacaataataataataatgatgcttttatcagctttttaaaacatctcattgctttgttatatcctattgtattagtaaaacttctaaaacattatcatattaaaagaatgctggccaggtgcagtggctcatgcctgtaatcccagcactttgggaggccaaggtgggaggattacttaagcccagaagtttgagactagcctgggcaacatagggagaccctgtctctatttaaaaataaaataaaaaattagctaggcacaccaacctgggtgacaaagctagaccctgtctcaaaaaattagccaggcatggttacacatgcctatagttccagctacccaggaggatgaggtgagaggattgcttgagctcgggaggttgaagctgcagtgaaccgtgattgtttcactgcactccagcctgagcaacagagtgagaccctatctcaaaacaaacaaacaaacaaaaaactgaaaagaatgctagtaggcacatttctatataccaacaacatccaagctgagtgccaaatcaagaatgcaatcccattcacaatagccacaaaaaataaaataaaatgcctagaaatacagctagccaggagggtgaaatatctctacaataaaaattacaaaacactgctgaaagaaatcagtgatgacacaaacaaatggaaaaacattccacactcatagataaaaataatcaatattgttaaaatggccatactgcccaaaacagtttaaagtttcagtgctatgattaaaaagtcaaaacataacagatgctggcaaggttgtgaagaaaagggaacgcttatatactgctggtgggaatgtaaattagttcagccactgtggaaagcagtttgatttctcaaagaacttagagctaccattggacccagcatcccatttttgggtatatacccaaaggaatataaatttgtttttaccataaagacacatgcatgcgtacgttcattgcagcactattcacaatagcagacatggaatcaacctagatgcacatcaatggtagactagataaagaaaacatggtttatatacaccatggaatactatgcagccatcaaaaagaatgatatcatgtcctttgcagcaacatggatggagcgagagaccattattgtaaatgaagggaaagaaaaccaaataccacatgttctcacttataagtggaagctaaacattgagtacacaatacaggtatacttgagggtggagggtagagggtgagaggaggctgagaacggaaaaactacctaccagataccatgcttataacctgggtgatgaaataatctgtacaccaaacccctgtgacatataatttacctatataacaaacctgcacatgtacccctgaaagtaaaaatttaaaaaaaaaaataatgcttgtaggcatatttctattgaatttaaaggagatgatactgtgagtcccattgtatattcttgtttaacatatgtttacttttaaatatttggaatggaatattttcagtatttcttaataaagcaagcctacaataatttatttagttcctaaaacttgccaagtaaaaatatagtctgattttataatcatacattttataaatcattttataaattcattatagtgtttataacacaaaagtaggtaaataaaaagcattttagatatgatgttgacaattgcatgctacgatccaatgagaagcctttttatcttgatgttttcataattttgaacagtactggtgattagcaaaatagctatatttaataataaaattttggtttaatatgaatgttagggaccacaaagagatcctacttcactctcactaggatggctataatcaaagcgacagatgctaagaagtgttgacaagcctgtggagaaactggaaccctcatacattgctggcaggaatgtaaaatggcacagccactttgaaaaccaatttgttatttcttcaaatatttaaacataagattctcttatggcctagcaacatcactcctaggtatgtacccaagaaaaatgaaaacataatgtccacacaaaaacttagcagcagtattcacaatagccaaaaagtggaaacaacccaaatgttcatcagctgatgaatggataaacaaaatcaacatatgggatatattcacacaatgggatattactgatacatgctatataacatgaataaaccttgaaaacattaaactaagcaaaagaaaccagacataaaaggcaataatattgtatgactacatttataccagatgtccatagagacagaaagtagaagtagattcgtagttgctaggggctaaaatggggagtggctgccacttggtacagggttcctttttggggtgataaaagtgtcctaaaattgattgtggttctgattgtacaattctgtgcatatacagaaaaccatggaattgtacaaattcatgctatgtgaattgtatctcagtaaagctattaaaatatgcatactatgtatgtaaaaaataattttatagacagtagcatctggtaaatgtttaacacttggctctaaatgtagttctgccaagaatacagttcatatttttgtttacattagctaataaaacaatggaggtgcatatcagaactttactcactcatcagtgatgtaaatgagttctttgcggaatcatattttagtaggagaatattttcttgatgtttgtgctattcccaatatggcagctatagacacgacatacttttaatttaacctgcattattaacattttccctgtcacattttaagtacagtcagtcaacaaaacaataaatcatagcctgatttgtagcatttgccaatgtatggagtaaatactccccctatcgtctttttcaagctaccaacataatgtcattaaacatatagttgagaagagatgtgcagtagtacactattgtatagtatttccaccatacggatactatagctgtaaacaatctcaaaagatgagtgaatgaatggtaaaatgtagcaaaataatttggaagttttgagtatctattatttttgtttttaattttttttgtatttctataatttaattttcaatgactgtgcttaacagcctgctcacagaatttctgaaaatgtggtaactgacttttgcaagctggtgtggaataataccactgaaataatacctgaatgaggaggctctgtacttacttacaatgtgaagcctagtttacacgataaatttgggctgtggagacatgtagacatgtagcctttaattaatgaagctttaaaaaaagggaaacaaggtaaaatgaaagttcaaaggatattaagcaggttattcattaatttgagattatgtattgagttcttaatatattcaagatgctgtaatgggtcctggtaatacgaaggtaaataaagatataatttctgcctttggggaatgcatagtcaagttgctgggctagatatgtgagcaaagcagatactgaaaggactatattatgataaaacagaaatatgttccaaagtctatggagaaaggagaagagaaggaggaagaaaaattaaatgagtattttttgaaagcgcaggcctgcattttggaagaagtttcatttgaattggatttaatggatgaagcgtgtattaggtgaaaatgagaatttaaagcaaagaatataggcttaaataaaatcaagagactataaaatggaatatgaatgggtgactcccaaaattcagatgctaaaaacctgttgtgtaattggcatatcctagttcattggccaaaggtacaaacacagtcccatcatttattactttcataactactatttatcctttttaatccttatttgcccttatttggtggacatacatcacttattcctaagctccaccctgctccatgaatttctatcaagtcctggttcttattgagattcagaggaaaggataatagtccttcattcccactttcaaacacaaggtaatacagttgggttccaacgtcacagctctctgacacaggtgtgattaattactttttcccaataaatagtacctggtgaatccagcttttctccacaacactaaggcccctggttagagactcaggtgtgagcttgacctcacctggcctgctctcagaattgactccattggactcctagtgtctaggctgtgagcagagcaatgcataagaagtgaagtggtaactttgcttagccgcacaaatttgtacaattaagagaaaccactgaaaagcctcttcacagaacaaagcactgctcaaattgactttctgttctgcctatattgagaagcaactggcagttcccagatctctttctctgtgtgggtgacacagtgatacacacacacacatatatacacatatatgtatacatatataaacacacatatatatacatatatatagagagaaaaatatatatattttctgccttaacaggattcctacttaatgtctggtttaagaggttccctattatcacattgataaaaagcagagtgttctgtaattactgctaccacctatgctttatcactttaagaaattatgtggaaataatctgatctttgcagtgcttattccttatgtgatcccagagtattgtaacattctcaatccttgattctgtctgatccaatctcaggtttgaaaatacagtaagattgttctctttagaatagagatgtgattgcgtcagtctcctatttgaaatcttccctcaacttcccattgccctgaaatggaagtctcacattttccacatgccatacatagaacagcgctgctcctgctcttgcgtcatcagggtccattcgtctcctaatcttccctctacttgcccctcgtctacactttagcttcagccccttcaaaactattttattttccccaaagctcccaggctttttctcactcatgctctttcctctctgtccagagtgtttttctattcttctctccaccgtcttctattccttccttgaatttcactgtcttacccacagcaagcccatctcaagactggttagagttctcctaggtgtccccatagcactgtagatacactcagtactggagccccaggcagggtggggtagtcaaagaacaggtgagccaagatggctgagaaagcagattgcttcttacatgggtgcaggagccattttttaggtgtggcagcacaaggcctgcaggtaaaagaaaagaaatgaattataaaattatgaaaaataaaagtgaataaaaatgaatttcacagttgatgtcggaaagaaaggagggtgatgtgagacagtaattcaggttccaatgaggaggtcaatcggcctctctgctaaggaatgtcagattccttatttatgatttttaaggtcccatatttactaaaattgtaatggaaaattaggcaacacctggagatttctatttatgagttccaggcattaagtcccacctaaaaacttaaacttggtcttataaaagacagtataaattattaatatatacatttttaaaactgtaatacatcttgattccattggcatataatgttaatcatcatactaggtagtattttgagacttattattgaattcgtgactaccttggcactataacagatagtcctggtacaaaaaaaaacaaaaacaaaaacaaaaacagtgctcttataaaaatgtaaacacaaagaatatttgatttgaaactgttttgtaatgttggttgacacttgccgtagaaatctgcaattgatttccaatcaatggaattgacatttattcattttgtaatgtaaatattctctaaaggagagggaattttatactaaaatatttctgtacaaagattaataataaagaaacctccttggagcctcagtttgcctcttaaaagtttgtagatattttctggacttgccttatctggtcatcagtgatgactatcacataaaaaatccggctggacgtggtggctcacgcctgtaatcctagcactttgggaggccaaggcgggcagatcacgaggtcagtagttcaagaccggcctggccaacatggtgaaaccccgtctctactaaaaacacaaaaataaattagtcgggcgtggtggcacgtgcctgtaatcccagctactccagaggctgagcaggagaattgcttaaacccgggaggcagaggctgcagtgagccaagatcgcatccctgcatcttagcctgggcgacagaggaagactctgtctctgggtttaggggcgggggaggaatccaagtctgtgaggaatctcttggagaacatgcagacataagctaaaatagagaaggctatatcatgccatattagaaatattagaagagcaataattttcatgaattattcttaaacaacgaacataagagaatacgattttatcctataaaaatgttgtcattgtggaacttgtagaattaagttacagatactcatgccctagtttagaaagattacatgtaagtgcattctgcttttctctgtgtttatgctgtagaatctctcataagcaaaatttcaagaaatacgtactatcaactcatagcttagccctgaggcttccagtacttaagaaacctccttccttgctccttaggatcgcagagttctcagggccctctggtaatattctttttttttttttttttttgcatttaatttttatttttattatttttattatactttaagttttagggtacatgtgcacattgtgcaggttagttacatatgtatacatgtgccatgctggtgcgctgcacccactaactcgtcatctagcattaggtatatctcccaatgctatccctcccccctccccccaccccaccacagtccccagagtgtgatattccccttcctgtgtccatgtgatctcattgttcaattcccacgtatgagtgagaatatgtggtgtttggttttttgttcttgcgatagtttactgagaatgatggtttccagtttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatagctgggtcaaatggtatttctagttctagatccctgaggaatcgccacactgacttccacaaaggaaacaacaggtgctggagaggatgtggagaaataggaacacttttacactgttggtgggactggtaatattcttaagtatctatggctaccacaaattgagagtttgcttacttcaaatgccagcaaaggtgttgctttttcattttcagcccctcacgtggtgcccatccctgagagttcctttgccccaatccagacttacaagaccccatcttatccctcaatttctggttccatttagcggtagcaagatcttaaaactagtatctactggaatatgtcagttctgtaatgctgactgaagcttgagtaaaccaggtgcttgtaaagtggcatgaaatatccagaaataaactttactttctacgggcattaaatttacttccaccttttagaaagagacttcaatttaccttattaaataactgaccaatctgtattcaccactaaaacattctaagtagcgtattgaaataagctaatctttacagtagtataactgattttatctgtgatgaaaatcccaaatatttattgtcacgatttttgttttttaatgtgtttttctacctatgtgttagcttctttaattcgaatgttattctctatgaattaaaaatattttaatagcattctcttaggatcttgcgtttatggttcctttttctttgcagccaaagattttctatctcccacattcgagactgagaaacaccttctatctgccctataaaatcttataatcagcaacgttatgtaccctttgatatcatgcttcgagaagggcatatcacctctgtggtatccttcgcaatcattcatgacctcaatctaatcatgagaaaacatcaggcaaaccgaacgggaaaaatgttctgtacaatagccgaccagtcctcttggaaattttacaagtaactcacattccattaaacaagccatgttgtcgaaagcacacattctatcaatttgacaaagattgaaaatccctgaaaaattattcttttagaaagatattttattaaatcaatgaaaagtgatcaaaatgttacctgtcagtttgcctaaaataagtgtgaacaaatagttttataacacttttccatcacttctctctgcaggtgactctgctaatctaacctgcagagctttctttgggtacagcggagatgtcagtcctttaatttactggatgaaaggagaaaaatttattgaagatctggatgaaaatcgagtttgggaaagtgacattaggtaattttttttccttttaacctgtatagtcaagattaacatttactccattagtgaatagaaagtaagctgaaaggatttttttttgttttactagtatcataataaaaatactacaatatttaatgataaagaagcaaaacactgttaacagacttactatggaattgcaaaacatgaatgccatttgcaaagaatttaagaaaaataacgaagattgttcattaagccacatactgagtgcggctgggggtggtggctctcgcctgtaatcccagcactttgggaggtcagattgggcggattgcttgaggccaagagtttgagactagcttggccaacatggagaaacgttgtctctactaaaaatacaaaaattagccaggcatggtggtgcgtgcctattgtccgggctactcgggaggctgaggcatgagaatcacttgaacctgggaggcagaggctgcagtgagccaagattctgccactgcactccagcctgaacaacagagtgagactctgtctccaaaaaaaaaaaaaaaaaaaaaatatatatatatatatatatatatatagtgagatcaaaataccataaaatatagaaaatgttagtgtactttttgtatatgagaccttttttttaaaaaaaaaaaaaaaaaatgttctttgggaggccgaggtgggcggatcacctgaggtcaagagtttgagaccagcctggccaacatggtgaaccccgtctctactgaaaatacaaaattagccgggcatggtggtgggcgcctgtagtcccagctactcgggaggctgaggcaggagaatcacctgaacctgggaggtggaggttgcagtgagccgagatcgcaccattgcactgcagcctgggcaacaagagcgaaactctgtctcaaaaaaaaaaaaaaaaaaaaattttcacaggaaacattaacaaggtacagggactcaagcaaacacaatctctgtcatttcctgctacgtatttttacatatttgagccaccaagtggaatataagcttttgatggtagtgataaggatacacaaaatgtgtttatcgcctttcttagtctgactttaaggtcgaaatatttgtatagtgggaatgataacatgaaaatatttgaaggcataatgcctaagccccttttttgttcaatgtgtttacttatttattcatttaagtatcaattataattcattcaatgctagctgtaattatgctttggcatagatacttatttttattcataatgtaaatatgcaagaacgttaataataataagtaagttacaaccacatcaaaatgatgattacttctaaacatactcccatctaaagattgcatcttctgggtatatacaaacattttaatcatggtcccccattctaaatgtcaagacttttaaaactttatcaaaggtaaaaaagaaaatgattttcaatagaaaaataacacattttctattgggaccttctttctggcaacaaatacataagaatattgtactctagaatgccccagtgggattccagaaggctagatggacaattgtctaatatgtactaaaacatttttctgctgattttcgtatttaaaacttcactcttatcttttacccatggtctatgaaatgctaaaataaatgaaggacaattaacctcctaacttttaccccctctggctttgtgtgtgttcagggaagtttctagaaaggtagtttaattctgcatttaaaaatgttgaacagagatgacaacgaggttagtgagcatttaccattaattttaatgtcagagttaaatacttcaccagaacttttagtctacaggtttatagtttcacgttccttcaaaaacaggcaatttgttagtatcattaacaaaagtcagactgaacatttcaactgaaatgtcaaaatagctcagaaattttcttttcttttttaaaaaattaacctgacatgtaattaggccttcagcctgagacattagaatttttatctcaacttacataatatttcttcttaaagggaaagcaatttgtaaactttttcttcaaggtctttctcacctctttattatgacagtgtgattgtcctgctaagggagataattaactgcaacttcattagcatctacaaagacaagcttcctcattacaagtgaagaagaaaagggcataacttaattaacacagcatcaattcatagccaaattagaagcacagattttgtaggtagttttacatcagattcggattcatctacatttctttcttgtttgtgtatgtgtctgtttgtgtggatttttgttttgttgctttacattttagaattcttaaggagcatcttggggaacaggaagtttccatctcattaattgtggactctgtggaagaaggtgacttgggaaattactcctgttatgttgaaaatggaaatggacgtcgacacgccagcgttctccttcataaacgaggtgagtgtaaccttctaagcttcggtggtcaactgaatgtatgatgggagaaaaaatcattgggaaccaagaaacaaatttagttttgtttttctccacaaagttctcctaaataaaataatcatatttgcattagagccaccgaggcaaacagcacagtagatgggtgagtaactcagtctctaaaatcaaatttgaaatccttgcttttctttaataccaactgtgtaactttgggcaaaacatttaacttccctaagctttagttatctgataaatagaatggggaaaataatagtatcaacccttcagtatgttgtcagaataaaataagacaaaaaaatgtgaagggcttgacagagcctatacaaggaaagtcgttaaatgctatttattattattagaaatagatattaggggccgggtgcagtggctcacacctgtaatcccagcactgtgggaggccaaggcaggtggatcacttgaggtcaggagttcaagaccagcctggccaacattgtgaaaccctgtctctactaaaaatacaaaaattagctggcggtagtggtgcaagtctgtaatcccagctatttgagaggctgaggcaggagaatcacttgagcctgggaggtggaggttgcggttaggcgagattgcgccattgcactccagcctgggtgacagagtgagaccctgtctcaaaaaaaaaaaaaaaaaaaaaaaagaaaagaaaagaaagaaaagagaaaaaaaaaaaacaactaaatggttttaagtcaaagattgtatttcttactggaagattgctcctttagtgtaagaactgtctggtgaattccccactgcagtattttttgacatattgtttctgccttggataactttcatttgtacaatagtctccaatgatgaataataatgcatttttaagtaagataagctgtggttaagtgcaatgtctgttgtgctaactctgcctctacagcaccccatcaccttttgcatagggttaagtgcatttaaatgtatattgaattgtttgaaataagtgacaactgtaaaatgtgagccattcctgttagtaaaattgtttgtgtatattacaagagaaaaataatttttctacattatgctaagttaaaactttctactctttggaacaagcacacttgatgttctcttactcagcaaatttacaacgattttaatttcaaagcccgtgtttaatcctagactctttgaggtttgaaaagaaagagaacattgaaggctgttcccccttctttattgggcaatagattccctttgaataatattactgaatgctgttaaaatagacacctctgttgtcaaggtgactatggtactaaaatagtctaccttttagggatgtgagtcaaggagaaaggtatgcagcagctaacaatatgattgtatctttctatagtttagtatatagccaatcaaggaagagattttagtagaaatatcatacatatacaaggacagaagtagcttctcatagttaaaagcaacttaagtgttgtgtaattgaacttcttatcctgccataacatcttctgaagtgatctatcagcttatactggatcacattcccttctcaaggaagtccattttatctttggaaaaatccgttagaaagcatttcactttcactgtctatccattggccctagttctgtacttttaatcactcttccccaagacagcccttcaagtgtttgatgacagtcaccatgagtctctgaacctttacttcactagattcagcctctttagcttcttttactcattcttcatttgtattagcgaaatacttttaccattctggtcactctcttgaatctgctttaattaaagagtttgaattagtcctcaaaaatggagttaggggagagaagatatagggcacataaaaatgtgttgacttgaacaacatattttggggggggacaagggaggggtgacagttaagtaggaatcaaaggagaaggggaggaaaatgaattatatctaaggataaagctattaaagctctgtttttacagagaggcacacagccaagaaggggtcaaaaaacctccaggctaagttgcccaaagctatgaaaccttccatttctagaaaaataaatgaagaatgaagaaaattatttgaaattttttccagtaatatttgatttcctaaacatgaaaaaaatgtggtcaatgttagagtattcttcagtacttaagtcttttagtatgtttttcaaatatgcgtttataccaacggcattttattcttgataaataaaagcattaacaagccaaaaaaaggtccttccaagacatgtactccaaaagtccctcttaaagtgaatgtatgccttccttttaagggagctgcagcaaatgagtcatcaattcacaaagacaccaatggatgcaatttcctgctcttgagggactcatgattatatggaatgatctatcccacccatcttggggggataaaaaggactttcgttcacatatgacatgacctgaactttaccagccctgcaaggttcaggagaacagcacacagcatatatgaaattataggtttgggtctttgatcattgagtctctaaaaagtcaaatgtctgtcatgctaacaattatgtaattatcaggtgagttgctatattactcagaatactaaggcttagataaggaactggaagctttcactattaattgtatttttctgccacttactcataaattccttaacttataagccttcacagtcttcccttttaaaacctccctagagagacatgttcaaacatttgttgaatactgatcttgtataccacaagctgtcattgcttctgacaggtaaaccttccaggacattcctttgccaaaattatctaagcaatttttccttcactgttaccttttgttcattatcattgacataataaaatgatttcagagccctccaatgggtggtatggattctttgaaacattgcttccttgtatcaaatgtgtcttccttaatgccaaggggatactataataaataattcagctacatttgagctaggctatgttctgggtcagccttttatctgcgtaaaagaatcataattccatgaaagcctgcagaaaatctaccaagaaatttgaccatagaaaaatcttgctcgagaatatccaaagttgccaattcctgcagccagaaaaggtattaggttcatcagaatctcatcagacatgcaatatagatatatttcacttactatacagagcactagaatatgcagcaagagaaagacagagaatgaaacggcaaggcccatgggccatattggtttatgactgccctgctccttactcttcactcctgccagaagcttctattcaatcctctttgccagactctggcctggcaagcttgagcattagatcctggcttcaaaaataataatcaaagtaaagcgctgacaaattagatattgggttacttcttgttcttgttattgctcatacttgattgaattccacatctgagtctttgaatcttttacccagatacacttgctactgcctgtccaacacacactgaacactgaccttcagttctcctccaaagctctgatctgtcctattctctccattttttacattttccatttctctgacacaaacaatagtccaggtagatacctagaagtattgtgctctgacctcaggcctagacactcttgtacccatcaagctgtctcagattccttcttcactctctgtgccttctgtctatactctcattttgaatgacctcacagtgtagacatgtttattatcttaatggttaagagcatggacttaggagtagggctggctgtgttcaaaacccaactctgttcttactagctgtgctatctggggcaaattacttaatcactttgagcctcaaatttctcttctataaaatgggaataataataagacctctcacatagagcagctgtgaggattcaatgaactcgtatgtgtaaatacttatcacagtgtctgacacatacttagcacccaaaaaatgttaagctattacaagatttccttgctctaactatgtgatactctggctaatgaaggatgcagcaattgtgtgttccattaaaaattccctgaattctaattcatctttcattaaaatcatcagctttagctccagcaattttgttctgtcaattctgaatttgactttataatagatatactgtggtttgaatgtactgtcctaaaggataattttgtttatttattcatgcatttaatgatgactaagaacctactatgtgcctggcatttgtgctggccaaagttacaggcatgaaaattaaaattaaatgaacaggaaataaggactaatataatttggaatgccatccactactttttaaattacagtgatattaaacattcctaatgtatgattgtgcttcctagtgaatgtttcactttgaaactgtcacattggggatgttcattagcaatcttactctgaagggttatgtttccttatatggattacaaaaatatggcaattcattaatcaaaatttagtttgggaactggcaaagtatctatctgagagactcagcactagttaataatgataaacatctaggttttctttatttcccatctaacccattttacttcttgtgtgcactctctttatcccttcaaagaatgtaatcgatagaaattagacctgctcaataaactccctagacctaaaagtatctttagtaatgtaattaagtgcacatcatttaggatgcattgttttaaagccagatgaatttaaacccagtggactcctttaacccttcttgtaacgaatcatccttgtaatatgtgccccatccttgttagtatttgcctagtgaatttatttactgagagttacagtaaggtcataaaacggtgcaaacttcttttggggctggccatttgacgtctttgaccattgatttcagaatatgttaaagccaaacttcgttcagaaatcaaaacctcctacctctctttatggcagcatttccctagaaagacaatgacccattaaaagctgagctaatgtcaatgaaatggatacttttactgagtcttagcttatgcagtgccaaaatattaaggaattttagtaatgttgctgcagcatctccaaataaaagtcaacaagtttaacaaattctctccttggataagatttgacattttatagtcaaaattttcttctgtcccgtaactgtttttttttttttttttttttttttttttttttgctggggggggcttctctgctcatttgtataagacgtctaatagcacaaattatccaatactaatgattttgtacctctgcacttcttttattatttatgtttatttttacagacaaggcctcattctgttgcccaggctagagtgcagtggtgtaatcatggctcaccgcaacctcgaattcctgggttcaagcaatcctctggcctcagcctcccttgtggctaggactacaggtgcatgccactacacctggctatttaaaaaaaaaaaattgtagagacagggtctccctatgtttcccaggctggtcttgaactcctcggcttaagcgatcctcctgtctcagtctcccaaagtggtgggattacaggcatgagccactgtgcccaactccctgtgtgcttcttgatacggatattccaacaaggctattgattgccaccaaagttgcagacatgactattaaccacttgagctatttccttagacttagaatatattatttaaatgagattaatcccaagttagttatttttttgcctcaaccgtgaaatgttttgaaggcttttttttttttttgagacggagtctcgctctatcgcacaggctggagtgcagtggtgtgatctcagctcactgcaacctccacctcctgagttcaagcaattctgttgaaggccttttgatcctagtttttgctaatcagttttaatatggaagtatgtcatgtaacattgtttggcctcttagccattttggtcacacagttttcttctctatgaatgagaataaccaagtagcatcattgttagaaaagaaaaggaccattgtctgctgatgattaacttttttctcaattaataaatgacaagagggtgatcctggacaaaaccaatgtcgagggccaagaataataaactctttagtctttaatcatgcctgttgatcattcatgtgggccaaagctcttaaatatttaattatacatggttatagtcactggaagtccttttttgctttattgagttttacacttgttttcttaactaaatgttcaattcttgatacagatctttaactagtatttctctcttacatgcttcaaagtaccaaacccacttagtaaatgtgatgaatgggctgattaagtgtattctgagtgatctaaactttgtctatagcaggatttctcaatcttgtcactactgacattttgggcttgataattctttgtcgttgtgggggctgtcctgtgcattgtagaccgtttagcagtactcctagcctctgcccactacatgtcaatacaaccttcctcagttatgaaaatcagaaatgtctccagacattgccagatgtccccaggggtcaaaattgctcctggtgacaagcactgctctacagtatagatataaaaaactcagtcttcctggaaatgatttcaacacttaagctgctcaatgtagggaaattcaaaatagaaggacaagtattttaatcttgaaaaccttccaagattataccaaatgtgactagaaggtcaacagaatggctgttcttacaccataggaattgacaaaagttaggtttcttctatttccatgcttagagagtcagctaaaagcccctagaccagtgcttcacaaactttacagtatgcacaaatcacctgggaactttgttaaaaagcaattcattagcctggggtaggactcaagattccaatttcaatcgagttccttattggtgttgccactattggtctgtggaccgcagctggcataccaaagcccttgcctagacaatagatctttctaattagcttggtagcctctaataggtaaagagaaactagttatcttgagctcactgtctccatgagaaaggaaccaaagctgagtagagccagtcagtaggactgtttttaattaattgcctcattctttttacatggtcaacacctttgaacctatttgaacagtggttcattgccctcacactctactcttaatgaggttacttgtttcacctattcaatgaattgtgctatataacatacttgctactcagagagatgtctgacagggcattttcttcaagtattcaaataattaacctcttaaatgaagagggccctcactgttggacccatttcctatttatctcattttttaaaaaggaaataaacttaggaatgtctcaacgacatatatatggatatacacatatgttttagcctatgcaaataggttgaatctcagcctatgcaaataacatatggaggaacacgatgtatggtgaacacgaaatactgctgattttctgttttgaacacttacttgtattcagctaactctcaattaagtgtggtaagaaaggatggaaatggtatggaaattgaactgccacatattattggtcaatgatatgcttcaaaagcaggagggagggagggagggagggagagaagggaagagaagggaagggagggaaggaaggagaggaaagaaggaaagaccatagaccatagcaacacagactggttaaaaccatctctccgagttcaaaagtttaattcattttaaaaggcatctgtctagcatctaacagaggctataaaacacaagtatttttacagctgaagcaactaaactagtgtgtgtatagtcaacagtacacaatgtatttgaatactgccaatttttatgtgaccactgagctgccagtggcagcagtctactcaagtgagggcagaaggaatccactggaactcatatcgatgtattagaaaatgataaacaggcagtgtagaaaaaataattaagtttaaaacatttgcaggaagcccacagaaattatctagcacacagcaaaattccacttgtgtaatcagagattccaaacaagatagtatattcctagccaccacctaccaacaaccaacccctcactcctccttctcagaaccaccttcatattttcattatttctgggtcaaaacaacctgttgattgacaatacttcataatcccactacaaatctcacttcactgcaggctgcttaaaagagataattcatataatgctgttgtttgaaaaagcgacaaatcattctaattcaacaaatatgtattgagtgccagctatgggcaaagcactgggttaggcatccttactagtggactgactgaccgctgccagaaggatatctaccaccatcctggagcattaaaacagcatttttgggaagagggagatagctgtgcatttttatggctgcaaattcctgcatttggtagagaaatggcacaactgggtcataaaatgcaaggtataacttttaataagtagttcctgtacgttgaacttttgacaaccaggtcagtaaagtgagaaattagacatgacgcatacaaaaatgctaactactatctcgggtcatatagtagggagaaaacgtgttgatttccagtaaattaccatggtaacttgtatagattttagtgttgagaattacatttgccatctgtgggaaatatattatctttttgtatctaattttagggcatgtgttctatttttagcatgtgttctatgaaaaataataaattgggaggccaatttggataaattaaaagtggatattaaaatgctataaaaatagaatttatttttaattcaaaaagaaaatccagtagtacatttaggaaagcacacaaaggtcatttttaaaaccacctcaaaattgttaccattaagcgaaatttgatatgaatgagaattgactaaaaagtgagaaattctgaactgtgataaaaaaaaatggacagttacctgagagtattttgcttttgactctttagctttgtgtgacctagagccaatctctttgtgtcattgttcttcagttttatcatttgtaaactaattgcccctagccgcactgtgggaatcttgaaagagcatatatgatactgggtgactaataatatacattagaccatttgtcagattttacagattctctgagtttttacacattgtgcctcaattttgccaattttgaaagtgagatatggtggttgctcttcctagggattttcttatgccttaagtgtttgaaaagttgactcagatctttagatggcaagtttctgtaactgcaaagtagaaattacaattccttacgacatgcaactgcagttcaaagtaccgacttacaatggttgccaaattcatgcaaactaaagtggaagaggccattttcaaagcctgaaagtattaaatataaattacctgacttaaatcagcttagaattataattctactctgtatgtgatgtaaaatgaatttgacttaaaaatttatttataccacctcacaatttcaaggtaatgactcacaactgcttgggtccatttctaattctccccaaacaaatatgtctgtaacatttaaataccttaatgttgaaagcaacttaaagaaatacattaaagataccgcaataaaattctatttagttaggcttcttcggtagactgctaccactggcaattcagcagtcacataaaagttggcagtattaaaatacattttcttctgtgggctgttcacatactagtttagtttcttcatctgaaaaacaatgcaattagtcaaaatgaaatttgaaatttttacctcctctaaaatcagatgattgactccacgttttatgtgaatattcataaactgttgccaaaactgattattatttatgaagagaaaagctccacagtggtgtttaaaaaattcctgttagacttgcattgctgaaccaggcatctttaaatgatagttgcataaacagataggcaaataaataaataattaggctaaagtggttaccaagagaactcttagcagaacatagcttgcaaaccacactggacaaattccattccaaactgtccagaataaaaggcaaaatataagctattttgtagtactagtatttaaagccatagatcaattacctatgttaaggctacatgaaaacctaatacattagaaagagatgcattaaataatttagtgaagtattaacagtggttacctcgaggtggcatgattccatgtgatctttaatttcttatcatccttatgcatttttcaaattctttactaaaagcatgttttatagagtcagaagaaaagtgagaaaataaatctattttggtatagctactgaatatttttgaaaatgcttataggaaacctatcattactctctgctataaaatcaagttatttacacatttttcaagtatattgaaatctatttgcttgaatatgtactcttgctcccactttgtctattttataaaaaaacattttaggggacaccttacttctacattattttctcaagccactgctagttttcatatgctgaaaatcaatacatacagtgggatgataaggtaatgctctattctttgtgaagcagagctatgttatgctattttggtaaaagataattcattattgaggacaagcccttcatgtataccagtacagaggccactaaactatgtgagccacagacttcttctcaagtttgtcatggtttaaggaaccatttactgctccctttggatgaggcaagtaatggtagggtctcctattggtagctcccaaaacatgctcattttttcatagattgttaatggggaggggggattttttttttaaaggttaacagagtcttgaaagcatctctttacaaaatgagaaagaaaggcaaatttaccactattttcctcagcatgtttatgaattcagaagtgttcataaacattcaacatagagaataaatatatttttctgttattcccactgggggaaatgaaccaacatatgatttttgctttaatgctttgtaactctggaatcaccaagattttgcatgaaacttgtctcaagagataaactattaccaacaaattttgccacacacattttcttctaatgctttcagtaagtcagaaatccattaaacccctaaagaaacaatattaaaataataacataaaattctgaagtttattaatgtatcccatttgtatattgcaatacaatcagtttatatgtgtgtacaatattttctaaatgtagttccatcaattaaatatactataaatcatcatactatatttgtttagaagagttcaatatttctgtagaaaacatggcttcttctattggttatctaggcagtccagatgttctgggttctttggccaatccaaagcattcccaatggaagaccaaattgttctaactatgacaatataccctcttgaggaaaattgctttcaggataaacatcacatcccttaacaaggagtaaaatggcaatgccaccttcactctgacagttttctctcaagagatgttttgtaacattccatctgtgcctgtctgtttgtatgacatgttaagaaggaaattcctagtagagggaaagcaatacttttctaaggtattttcttttaggcatcagtgaagtttgacaccttgatatacaatagccctgtcttctaagctggtcacctgaggccctttttgtttgttattataacagtatcttccttctttgtctgtcttctccccatcatacttaatcttatgagatctgagataaaggaagccccatctgaatactttgtacctgtatgtgtgtgcaaacacacataatggtctgtgtacatctcacattatagtctttagatagaaatatttcaaacactgcctttataatctaaaggggaaaggttttctgcaataaagctctgtctgtgttagtaacttcacagtatacattttgaaaatatatggcaatttttcccaagggagaatcattgtcctattgtactgacctaactttgcgaaacctggtttaatgggttccatgaatccgcaaacaaatatttattgaaaaggtacatgctatttgctttgaaaataaaaaaagataacatattctagctgagaaatcaaagcatgagtttgcctaccttcacctatcacatcacacattcattttcccagtgctccagaccaaactacttgccaaaatcctttgcagctacctttgcattgtgtcattctgtgtctgacccctgtctctaaaatactcctacagaaacacacacacatacaaataccccaactgaatttctcatctggcttataattgtgatacttataatgtagcatttcttatataaaaggggtctagcacagtgacacttaagtgctcaataaatatcagctcttattattattatttattattatctgcttacatgtctgactctgaaactagacatgagcacctttaacgcaaaaacatatttcatccatcactttcactttatcactagaactcaaaagcactgtacctggtacagagaaggcacttataaaacaaatagaaaatgtatgtattagtaagaaaatttgaatagcagtatcaaagatgtgaagcagtacatgattgatttccaaatgtcaagtgaatacaaacattcttagttctgtaagtctatacaagactgtattgtcattagctttgtgaatgaaaaaaagaacagaaaccaaacaccacatgttctcactcataagtgggagtagaacaatgagaacacagggacacagggaggggaacatcacacaccggggcctgtctcagggtgggggcctaggggagggatagcattaggagaaatacctcatgtagatgacaggttgatgggtgcagcaaaccaccatgccacgtgtatacctatgtaacaaacctgcgcgttctgcacatgtaccccagaacttataataaaagaaaatggaacaataatttttaaatctatactatgaagttgatcatttttctatatattaaaagtttattcctaacttaatggactgaatattaatgctataattataccttatcagttgcttgaaccttaggatacattgactagatacacagacatattcttggaattttagaatagaaacacataaaacctagctttttattcaaaattgggtttgttcttaatcatctaatcagtcattcattttcactgaatatctttaatgtgtcagatagttagcaaggtatttgggataagtagtgaaagatatagacaaaatagacaaaaaaaaaaaaaaaagagagagaagacaaaaaacttgtcctgatggaatttaaatcccagtggaagacaaataataaacaataatacatttattgataagcaaatgaaatattatgttatatagtgatgaatactataaaaaataaagacaagtagatgcaaaatgcagccacaggtttgtgacttggaacgagtggtcagtgtatccaattgagaaggtgccgtatgagcagagacttgaagaagcaaagagagaggcatgtagaaatctaggggaaatactctctagtcagagggaagccagagcaaaggtcctaagataaagtcattgcttacaatgtaaaacaataaacaaaactaactctgatataattcaatatggtaaatgaaaaaaaaaaggaacaggaaatacatgttctaaagaggaaaaaaatcacgtttagttggaaaagttatattggaagtgcaagatcctaacctttccttgaaggactggttgggttttggtaaatgaagaacttctggtttggaacaaaaaactcatgtcaaatttaatttacattagaaggatgattatggctaaaggttagttagctgcttcaattaaaggaataaagaaacttaaatgcccacataaggggtttagactttgttccatgggcaatgtaaatcagctaagagatcctgcagaaaattccagggtgaagacatgatctgggaagatgaaattgaaggctttgtgcagattcgtgtacaatagctgtaaataacagaattttaatacaaaggtaatcaacctgaagtacactctaattacaataacacttgcaattattatcttacaatttgaccttttattttttaactttctattttggaatacaaaaactgcagatattatagaaaattacaagaacagtgcaataaattttcatatatcttctccacctagatttaccaattaatagatttgccacatttaccttatctctcttcctacatataggtaggtaaaaagagctgcactacatatacacacacacacacaacatatcattgctaaaccccatgagagcacattgcagacactgaaactaaattcttcaatgtgaatcccctaaaaacaagaattttttatgtaaccaggatacatttatcaaattcaggaaaattcaaaattacaaaatgccattgcctatgatatagtctatattcaaatttcaaaaattgtcccagtacataccctttacaccatatttaccatctaggataatgcactgcatttaactgccaattctctttagtctcctttaatctggtatggttcctcagcttttcttcgtctttgataacactgacatttcgaagagtagaagctagatggttttattttttatagttgtccctcagtttggattggctggacatttccttattttttttggatgtttatgtgtttctggctataatactacttaaatgatattgtgccctcttattgcagtacaccgggggtgggggggatgatatcaagttgtcccgttattggtgatgttaaatttggtcacttccttaaaatgatgtccatttttccccagtgaggaggtactatgagacggtgtgaatatcctgcctcaccaatctttcaaccaataattttaacgtctattgataatttttgcctgaatcaattattattatgatggctgaaaaatggtcatttctaactatatcgttcatttcatatttaccggttgacattctgctcttagggagagctttcccttcttgttggtttatttgtaactaatatgaacacatggatttgtgctttattcagttactgccattattcattttaactcatcttttaaaacataccacctatgaatacttcttaattcacagagagaaaaaccagcttaacacccttcttgcctagttgaaagagaaaaaaagcacattccaagggtaggctctagcatgctgtgaagagaatgttacactttttcttctagcctttcattttatttttcactttgaatagttcattaacacataacaatgaagttccaaggacctgtgggaccttagtctaactgggctctaatgatgggtcctagccaacaaccatatttgcattttgattggcagtaagtagaagttaatttggtgcttcgtctaaaaacctctttccaaatggcaaaatatactactttggaggtaatcttttgcccaaatgtttggtcatacagattaagccgctccattcagggatcatttttatttttattattataattttgggggtttataccctgacttcccaaaaaggacttttgcaagatcaaaactgttattcttacatactggtttgtactttcccaaaacattttcttcctttatgtgaatagcagcttgatttgttaatgtgtttcccccaccccccgcaaaaataactgcttttaaattacactgatgtattgtagaactgagttgagtatctttgtaggctgagcataattatcctcctgccaggaacaaataagttatactgctccagagaaataaatatgcatatgaatttatgtggatggataaattcttataaactttagctctttataacacaatgagagaaaaagaaatgtacctggtgaggctaatgaataaactgggatcattataatgtctgtcatgcattttccccacaaacttgcattttactgcatataaatgagggaagaacacttcaaaagactttttataatgaacgaaccaactttaggataaactacacaaaagtaagccatctaaaatcttcagttataccttctggcaaaattctatatatataggaacacacacacacacacacacacacacacacacacacacacagatcaaatagagatactgactaaaaactgcaagtcaagagttcaaaaatacatatgaacttttacttactttgttaaaagctttaccttttcgaagatttctagcagaaaatgtttgcaaacaataacaccaggtacaggccaagaaaagaacatagtttcccatagtatactaggtaattgcagcaagatcagtggaaaccaaatgcatttattatttgcaatgtaattcaatatactaagagatggcacgcactttattttaattagctgtttcttttaaggggttgcttgctcccactgtcttgataagaaaaaattgtagtcattgctcaaaatgcttgtagcaaatctagttttaaattgaaacaatttattccaaagcagtctactactgcagcaataatcaatgtgttttcccttagcctgtactggagctttcctaggactattgttaattgcctgtaactaaatgatcgctggggcccttaaatgcaactctttggcacttgttcatttgttgtttttaaccaaatgccagttttccctaggttttgcctagcaattttgctttacaattttcaatattcagtctcagtcccttaaagggggcagagtctatcattttaacaaaatacacaaaggctaaacagattttaaaaggtctgcatttctccttctgtcctcagatgttgaattgtgctgaaatgatatctttttattttttaaatgctgccactccaggcaacttgaactagagctgaaaagtagatcccatttcaaagggaaaatgacatttgctggggcaacaccatttacattgtaatgtaaagataaaatacagcagtgggcccaaatgatttctcttaactgtgacagaatttaatccttagtaattttgtataacccaaaggataagcaataataggtagcgcatgtattaatgaatctgtctggcttggagcaaaagaatacagaggctaaatctaatgcacaattttctttgaaagggttttcatatgctatataaaccagtgtgacttaaatagaaaaaaaatttaacttgcatacatgtataatgtgtaggcttgtatattacactcctgcatagaaatattgtaataactgaggggcaggcactgtgcaccatggggaaagacacatttccattttgttcctgacctctttataaggacattataagaacactatgcttctgcaatgtaatactacagaagtctctgggggaaagtctgtgatgctctcaggatctcaggataaattagctccttgtaaattctgtttctttagacttgtttttggtattcctattattagtaaatgactatctatggcccagaagaattattcttgcttattgctcattctctaagcatatataacttttcatatgtttgtaccctaaaggagtttttcatgtgacacaagactgtttctgtaactgctaagctacatcaaccctgctctctttttcttattatattttaaacaacactattgattggctatgtagagtattctaagtaatgtatatcatttcttaaatggctcgtgacatgtagcaatgggagtaactcctatctgggtaattactttgctaaaaataagaaggacttattttcatacaatttttctctaatttacctgtattcaatttctcaaaattaaaaaagtatgtagagaccagtattataaataccatctggagaaaatgagagttctgtttattagattgatcagattatatttcaggcaaatattttttattatttccaaagctcctcgactatctatgggcacttaaggcatgccacatgcccagcccctgtgtagtgcctccagatataaagaatgtgcttgggggcaccgtaaaagaatcattccctgcctgggcccttatctacagcagagcagctttcctgactcccagctttcttcccacacttctccccacataggcctttggttagaacttacgtttttcttaaaaaaagaaaaatcaaaatgttaaagaattgaaatatgattcacataatataaagcgtgtagctctaagtgtttggctaaatgagttccgacaaatataaacacttgtgtatccacaccataaacctatttcctttaccccagaaagtttcctcttgctccattccaacaagtttcccttcactcatcatcaatgaatctattttctgatttatgtcactatggatcatgttggtctgttcttgagtgtaatttaaatagaatcatacagtaggtattatttcttgtctggcttcctttttctaacataattttgtgagagtcatgcatgttttgcgtatcagtagtttactacttttattgctgagtatattctatcatatgaacatacaatagtttgttcatcatttcctgttaatggacatttaagttgtctctatttgtggctgctgtgaataaataagactattctgagcattctcatacaactcttcttgcagatatctgcttatatttctcttggacaaatacctaggagtggaactgctattgatatggtagatttttatttaattttattagaaattaccccaaagtttacaatgtggtaatatcactgggtactctcactagcaatgtttgggagtggaagctaagtgttcttgattctttttccatttctttttttgtacaagaaatttttgagtggtaaattcctagtgtttaatatactaaattagaaaatcttaaaagaagccatagtcaaaatgcttatttctcacattatatccaatgtattttaaatcatatcttcctgatgtataaatcaccctgtgggcataagttagaattttacacaggcttctgtgtatggtggagtttattatcttgagtgaacaagacccaatgtatccccacaggattagccgctcaccctttctgttcatataatagggggaaaacattatactgaagagctttttgtattttgttcctggtatttttgtagtactgtcttgtgtggttccccacaatgttaatcagataagctgctggaggtatttttcagtgttttacacttcatattaatttacttagactctaaaagagttgatctcactttattttttcttagatgcatacagttcaatcgttttaaataagattttcttcaatttcccatttaattttaataattacagaaaaacacacttgattaaacagcagttaatgtgttgtttattaaactgtagaattagaaatcaagggctaggtaataggaaatatgaatgaggatttttttttttttttttttgagacggagtctcgttctgtcgcccaggctggagtgtagtggcgcgatctcagctcactgcaacctccacctcctgggttcaagcgattctcctgtctcagcctcccaagtagctgggattacaggtgcctgccaccatccccagctaatttttgtatttttagtagagacagggtttcgccacgttggccaggctggtctcaaactcctgacctcaggtgatctgcccgccttggcctcccaaagtgctgggattacatgtgtgagccaccgtgcccagtctgaggactttttttcctgtaattattacaggaaaagtgacatcacctgcacacacacacatacacaatgttcttgtaagaaaatgatggccgtgcttttcagattatttgtcactcatattacaccagtcccatcatgatttcaccccatttgtgagaactcaggactgatctgataacctgagggtacttgttaccagcaaaaccgtggatcattttaaagttctcagtctaagcttacattgactgtgttatgaaattagataacttactggtggattctgaattacagaatcaagaataacattattttacagctttaatttcagaaatgtttatatttaattgtagttaaggaaactagtacttttcaaggtagttgtcaactgcagggaacaatggctacccatcagtaacaacatttgggctgtgatgattaccgacaacgcttaaagtgagtttcaaaaatctatgcatgatggcttactatttaaataccaatatccttatttttgttacaatgtccatggttctaaagaaggaaaaaataacaaaaaattttatctccaagttttcctgataagttttgatctaaggtagatattcagtagaaaaaggagaatttgtatacagtgagtgtcaagaaaattccttttttggatagaacgtagtaacatgcctggtaaaaggggaagcaaaaatcttaaaaagtaaacggttgaatgaaaataaaacaccaccaacatattcatatactgtcccatccactaggaggcctacttcttacacccaaaaagcattcagcctccaagattatggtagaccaccttggtatcactgtattcaggaagatacagcagaggagctattgctcctggcaggagtcagcagacagcattcattagatagtcttcccaacattctatgcaacaatccacagtgctctcctgaaactgtgttgtttgacctctcacctttctttggcccccaacccacaggtgacagctcaagtgagagggatcaagattctcattgggagaggccaaaagtcatcctggcttaaaagcttcatatccacaggaatcagtatttattttatcaaccccataagcatagcttccgggatctccacaagtgatacatttatataagagagttatggtactctgttaaacccaatattatagtttccaatcagatatttacaattctcttaatccaaatgcaagctaccaaccaaggttcatttttaccacaagcaatgttgcttagcaacatggttgtcacataccaccttatctagttaccaaggaaacagagctagaaagttatcaaaaggtcaaattctcatgcaaaaaggaaaggggttgtgtcaacccgttaacccacatctgatctcatccaggaaaatgtgaaatcaaactgagtttaatttatgattttggatgtgaataccatataattccccattgtggttttttctttctagagctaatgtacacagtggaacttgctggaggccttggtgctatactcttgctgcttgtatgtttggtgaccatctacaagtgttacaagatagaaatcatgctcttctacaggaatcattttggagctgaagagctcgatggaggtaggatgttacctcttttattgttctttctgaatgttctaatttctttcttgtctttgttttattaaggggaaaaaaattacgtgcataatcaatggcagcagctcgtatattctttcagtgctcagtttgtaaatttctcttttgtaaggaaatgtgtgatgctttatagccaatactgtaggtattttcctctgaaagttgtaaagcaacacctatccattttagaattgtattccaaacacttacaaattacaaacactgattgcaatgccatcagagtgttccttttctctcaccttgtaatcaggactgaaaggccagttttacttttttttaggtaaggagtgtctcttttaattgtgttttctagcccagtagtttgaagcgaatctcaatttgctcctgtttagactgatccgttataataaactgtactgagtattttaaattcatccagcagtcttttcaatcttgtttatttagctatatttagatagcctaatttttattccaagtgtggaccaacagaaaaatgcacaagcacattaatttcatagtaatgcatctcatatttttactgtacgtagacaaataaatattgttttgtggaaatcataattagtatttgcttctggtcaccaatgaatatgtgtacaatctaagaggaaaatggagtccttaaaattcagctccctaaactgcacattagacttatgtttttaaaaaataacaaaaaggaaaataaactaagataaaccagcaagatgggaagcatatgcaaactgacaatgaatagtacagatgacaaagctttcttcatcattttttttttttttagtgaggtggagtttcactcttgttgcccaagctggagtgcaatggcgcgatctcagctcactgcaacctccgcctcccgggttcaagcgatcctcctgcttcaacctcccgagtagctgggattacaggcgcccgtcatcacacccagctaattttttgtatttttaatagagacagggtttcaccatgttggtcaggctggtcttgaacccctgacctcaggtgatccccccatctcggcctcccaaagtgctgggattacaggcacgagctactgcacccggtctcatcatatttatatactgtttttttttcagtgattttcagttttgcagtaaatggtaccaaggaaaatgaggcaattgcctatgttgccacgtttccagggtcctctggaataataaatccacaagcaaaactagttttgcaggtttgtaaagagaagtggtttattcagaatgcctaacactcctcttggtttacccttctctccttcccattagggtgaagcctgagctgcagcaaaaccctttctttttcttaagtttttaattgctgatttgcctatttgtttctaactttcttgcctattgatgcaaattattattattactattgctgctgttttaaagaaatataaggactttgccattgtcggaactactgttgaatgagcaccaagcatagtgctaggcattcttagagtcattcttgctaaccctcacaaacatcctgaggtcaatattgtaatctccattttactgataaggcaactgagactttcagaggttaaataacttactcaagaagataacacaaatactgtaagtgtccaagatgggatttgaaaataagtctattcccaaagcctttatcttatcggatactctctattatttgtattttttttaaatttagtatgttcagtatcatctaaagatctactgttgtttgcacaattagcacagtacatggtatttgaaaaagcacattacctaaacaagtctccccttttctattaaccctgttttgaatatgtttattttgtgttctgaatgagatgaatcattttaccaaactatcaatttctagggcagtaatctgtcattttctgaatgtagaaaattctggaatataatgaaaatgaattaatcatacgcagtggaactttcagtgattcgaagtttcgtttagtgggtcctgctaattgtaaacacttcagtgactgacttgggtagccttaccatatttcattgctgttctgaagctgctgggttctcagttttttaaaaaatgttttaagtaagaaaacaaagcagacagacactaacaaacagtattctaacagatgagaaggttctcttggaaagcaatttagttaataaatcctttagcgattcttagaactctgtctctgaggccatcttaagcacaatcgagggtctaactattagggcttttcttgaaatgccactgaaaatgaattagacccaaagaaaaccaagataacaaacttaactgtcatctggaatatgttaatgtacaagttattcccctaaaaagcggggggcagggggaagcaaagactgtcaaggcagtgattgttcaaatggttttatgggaagaaattattactagaaccgcaatcacatgttcagcctccctatattaaagcagacccgttcctgctgaaatggtggtcagggccccactcttaactcgtatctcccgctgcatcacacctaacctctagaacttccagacactgttttatcagaaccatacagcagtactaataattatatagcaagtttaaaatctatatcttaacaaaagttagaagtgtataattgcaactttctttaattctctagtgctctaaaaccattcagcttggctctcaagttcccatttctactgagaaaaaactcataaccttgcttctccaagattactccgtcacttctggtttggaattcagcttcttgtgggttaacactcagttgaaaattggaatattccatttcccttcttctcttttactcttgtttaaacctgtttccagggaactcatatgtagctttctggtaaaggaaaaagtcacctggtgcatatgccatcccttcctcacttgagatactaccacctggtctttggacatgttgagcactgacttctgaaggcgtagatccttgtcatggcctccagtcacaagtttcacacacttgcccagatgtttctcccttgggaatttcagacattcttacctgtgtttctagtcccataaactcggctacacgcatacccaccttcccattaaaaaaaaaaaagtaatcatcttcttcatcctttgcctctttcatatacggtttccacattgagtgcaggatttctctatgaagtttacagtttcccaagattttccctgggaaacttgacacaaatcctcgcccttctcagattctgcctcaaaccatatgaagttctgttatcctcttctcctctctgtggccctgagggcccccttctcagaaacccatgcaggctgtaaaccttagtcacagccccttagagcctcctatacatgcttttatggtcaaagaatggtctactcttccaatagtgaaaaacttctctgacatcatcaaatccccatgcttcctagctctgcaagctttttcctcttccaaagaagagatggctattcaacaaaacccaaggctttgtaaattcttgtcttttaaaaaatgtaatttagagtcaaacctgagtattgccttctttattcatggctatcatatttaccttccctgaaggggtaatttataaaatacttttgaaagtaagataaggcaaaaagtgtgaaaaataaccagggaaaaatgtttaataatatcctactatagcaatatgataataatagattcaatggccatttattgaataacaagtgatgtgttgactactttatcaataatcagagaatcacacaattagaaagacagaatttaagctccggtctaaatggctctaaattccaagatatacagccattttatcagacttgcagatggagtttctggcatcagggacacattcactcagttcctttggagtcattacaaaaggcattacctggctatatcagttctttatcagaaggattatgattgatatagaaggattctaatattttttaaagatagaacatattgatgcttttctctctcagttcgttcacatcactccttgttcccctctatataaccttacattttattatctcccctgcattcagtccttagcatttccaattccacaacactccccgcccatactcattctttgtcatcctccattttacacctcagttcctggtatcaccttctatctcattggccacactttcccctcatatgccatttctaattagtcatcaatatcagtcaattgcacctctcaaaaatagatattttccttacccttaattgcaactgctttgtccaagcctcctacaccaccctcttgttttcattctctacttctctatcttatccttcacattctaacagaattatctaagtacaaatttactgttccattttttaaaatgcctccattttgcctgctagaacagtctagacttagctcagaaagcaattgccatcaaagggtgacccaccttacttttgtagcattgccacccccatgggatctcaacatgcagagttctagttagaataagatgttagtctttgtaataacacagctattgagaatgaacctaagacaatgtaatcttgcataattctctgaggtttttggggaaaatgaagtaaccacaatggttaaggggaggagaagatacgctatccccctaccactttgattccacaataaaaggaaagaaagtttggataaattctgccagaaaaatatttattagcagacagccttatcactcaacttataaatcagaagaagttccaattctgttgtatatgtgtgtgtttgtgtgcatgtatgaatctgcatgtgtgcatgcttttcagaaaccttgcaagaaattttctcccaaggcaaatgtggcaatactccagtggtaggattgaactcaccttctgttgacatccaagaataattttcatcaagaccattttggaattaagcctagaagatcttctccaagggggcagaccactggccctgctagatttttgtaagggtgggaatgtgtttctaaattgtgttaagtaattcatatgtcttgattaacactgattttaccatggaaataccatttccaagacccattgtacacagtaaaaagccactatctttagcaatgaaacttgatttctaatatccattgtgttaattgatgaagcatctacttttgatcagaaatatagtttaagtgcttgtagtgaccgcctctggagtgttgcctcattttagttaaatgcttgctgaccatcctaataagggcaagctactgtctttagagtagaacttatactaacaaagtaccaccaccatttatgctggaaagattttaaaaaacaatacagacatcacaacagtgttagactcctttgctcctccatgtctctgaatggagtgtcccttcaagttttgtttaaagttataatcctactttatatatttttttcagagtgtaaaatggtttttgttgttgttttcagctttttttccttctctgactatgaagtatgtggggcatgcttactcataatgacgccagggcaagcttataagaacactgtaatcactaacacgaatcctattttaaagatgaagaaagagatctcctagtcctacgttgggagttattacaggcattgaacaaaattagttagagcaattttttataatctccacctccatctcagaaaatgtgaacatctgttccatttcaggcatattaagcacattggcatctatgaaatcttaggccatagaatttctttttctttctctttcaatgacaaggtcactcactattcatagtttcaggaattattgtcctcatgtccatcagtgaaacatagtacctctgcaaatcatttaaaaaccttatagggattttttttggtgtttttttttttttttggtgggggggtgggtggtggtggtagttagaccatttacatacacaggaataatctttagaagctagaacaagtttttggatcccagaaggagagatgtagagttgttctgggtatatgacttgcctcaaatcattaactgttaaatggtaggaaccgaggcttcttatcccaaatcttgtgctccctttgctattctgctactttttaatccccttaagacttctgaatctatgttgcctgctgccctcttagggatacaagagaaggaaataaatatctatagaatgactcctttggaccaggcattttgctatatgatggggtctcatttaattttagacatcttcaggaaggtgctattttatagatcaggaaatatagtcccaaatgagttatataaaaagttatggcaatcaagatttgagctaagcttctgggtgtttttttcactactttataccacagatattttaactagtatcaaatttaagtgtttgagaacttatagattcaaataatccagaaaagtaccaaatggcacaacatgtgaattagaacagtactgtaaatacttcaaactgtacaagtcaagcaaatttattttacaacaattgccagaggttgtcatagcagaattgaaaagcaaaatttattaagacaatgacattcaataatcataaaatcaaaccattaaggttttatatatctaatgtttattcattcaaagatatatgatctctgaagataattttatttgaaaaatcatatcttgaaaacttgagaaagcatatgatggcaaatctgagacataagaagaaatgtgacttactttttgaaaactataatttattcaaattttatcaatgcaaatttttaattatcacagttttctgtgatgatatgccacacttaaacatacaaaatcaacttttaggattaaaaaaagatgaactatacaatttatctttgaaccctcctccagtttcattttaggaatccatttactgaatgacagcctctgccactagtcaatttcacttatgtgattcatatatacttgagaacaaaaaaaaaaagaaaaaaaaaaaaggaatggccagctgccaaaaacatttgacaactattcagtaagtgtttagaggttaaaaactcccccaaaccggatgtcatacttaaaacatttctactgtcagtaaatcttttttctagccaaatccaatacagccactaccttcaacttgaaaagtgagtcttcaacctacattttcttaaaagctgtgttattctaaaataatcccgcagattccttgcttcctcagtcattttaaagaacattgagggtattatcctctcatatgttaaagagaaaggtgcatttatctataacctttccaaaccctcttttcattcctgaacataatgccattttttccttcttcatcaagagttcttaatattttaaattcatattttttatttgttaacgccacagagtccaaacttccttctttcctctcaaaaatgtttttataaaacatcaaagcttttagttaattcaatttaagaagaaatatctgctggacttgttgattgacttcaagtaaccaaacaactagttgaatgattggatcttgttttttgtttgtttggtggagcatatctgccggggtcttttgaaagtcataagaaagagtaacttaatgactacattgcagattataaagaattactacaaagagtgtgtataccagctgtttttcatctctgctgtgaacagaattatagttgatgcttaaattgcagaggattttgagaataaagctcagaataagaaatagactcttgtaccaacctataactacttttaagctgtttataaatgaaagttgaatttaaattatcctagccctatcctttaaaaatattagcataattttgtttttcatggttataaagatgtcagcttttcaaagtttcaccagtcacatgaagttcatacacattaaactatgtcaatttatgttctttcttatatcaaaacaatctaagatgtactatccaagatgcatatacagttggtaattgaaaaagggaagacaccttagaatccatatgattttgagtcaaaaaacattgctgaatttagtatggcatctggcactctgcttccggtctgacaacttttcaaatcatgggtttgcttctgatggtaaataaatgcctaacccattactgcactgatgcagactctggagaaagagagaaattagatatcactcaagtgtcccattggtttgaggatggtgctgcagatgcttgaaagaggctttctaccagtataatctacttggaaacaactccattataactgggagatactaacttaagtactataaatacatccagatgacataaggagatagaaaactaactgatgtcatagcaccaattcctaaatttcatttaagattaatatggttatttcatatattagtctaggcaaaaatttatcccctttttgataaaaacatgaattcttagctattttattgggagtatatctcctctaagtattaggacgatctatcatggagccgagggggcaaggtttagtttttatgatgttgtggtcaaatacctggcagataactgcagttgtttggtgtcattgagacctctgcatgcctatatcctgttctagaacagagtttattgaagtgtggtccctcaatcagcagcagcatctcttgagagtttgctataaatataaattctaggaacctactcttcacctactgaatgagaaactctagaggtggggctcagccctccaaatgatggtcattcatgctcaagtctgaaaaccactttcctagaggcatttacacagatcctaaggccttttttttttttttctttttttttgagacagagtctcgctctgtcacccaggctggagtgcagtggtgcagtctcggctcactgcaagctccgcctcccgggttcacgccattctcctgcctcagcctcccgagtagctgggactacaggcgcccgcaaccacgcctggctaaatttttttgtatttttagtagagacgaggtttcaccgtgttagccaggatggtctcgatctcctgaccttgtgatctgcctgcctcggcctcccaaagtcctgggattacaggcgtgagccaccacacctggccaaccctaatgtcttttcatgaatcacagtaagaagctacagttcaagagtattccaaaggagccttgctaaactctgaaccacagctcctagtaattccttgagaagtcagagcagcatggagtctacatctccaaagcagtctctcctgagaaatgatccgagtcttgagaaaaatctcaaaattagctatcgggtgtgagtcatgtgataccaaaatgaaaggccattcgttcatttcatcaactgataaacttgagcatctactaagccccagtcacatacctgagctaaggatctcatagtctaagagagaagataagatataagcaaaatcatataatacatgggaaaaatcatcacttccaactgagggaaatcaggctaaccttcaaggaaaacaagctaaaaatgcagctgctgattatttagacaataagtagccacagatattttttaagccaccataacacatgatcagtggtaaggtctgggaaggtaaatttggtgactctcttctccagaaggagaaggaaatggaaagggaagaccactcaaatataattataacagctgagatatgagtagggcctaacctagaatggaaatagaatccaatagatttgtaccaatgaatggcgatgagattattagtaaagataagggataggtggaacgcgcatctgaagttttgacattaaagaaatgagatttttatgttactaaaattaaaatgaaataaaagatgaagaacacagcttgagatgggaagcttgttacgttgtgagcatgtgaagtgtgaggtgcatgatgaagatgcaaattaaagtgttcaggttacaggtaggagtgggggactgtcataattcaggagaaatagaacaggatcatgcatccaaattgaggaggcatctacacagaagtgatgttatggaagttgatgttatggaaggaaaggatatttttaagggaaagtgggctgaaagaaaaatgaagtggaccgcagaaaacatcttgcagaaagacggtatttatgggttggaagagaggtttccatgaaagaagcaggggaatcagagacataatgttatataagcaaaggcgatatttatctgaaatttaccagtatgggtggaccagttgtttacatctcgtctgatttctgaatgctccgttcttactggtgttcatatgttgatatggctttaaaataatcttaagcctagagaagatatgaggcaatgaatgaggatctaattattacacaaccccagttgaggggagtttcaacactttgcactactttgtggcaaactggaaaagaacagattaccagaaagaaaatagcatatgcccaaaataatactacaatccacaatctggcctgaggagtccttccattattagcctgtgactcctgaactacccttagtaatacatttatctcttaggaatgtactatttatttgtctgcatctcctgctaggctagaaactaatgaccaatattgtaaagaaagtttaatatctcataggtaatgcatgtgaatagttaatgaatattttaattaattattaaccgatattatgtactgactttattgtgtgctttcatgatttcttactcaactaaagtgtttacatcaatgagtggtacaattatagattgtactggcctatgggcatatagcttttctatagcaaatataataattatttttggagaaaactagattttgttttttaaaatgtacaactatatgctggctaaagaataaaggaaatgccaaaatatgacacatttggtatgattgtttttcttaaacttttttgccctaaaagctgctgtttaaaaaactcttctatagctgaagtttttattccaagtatcctatagtgaagttgttagtgccttatatacctgtgttaactttacatgtagcaaacacttttctgagtttgccctgaaaagttataatcatagaatgatttctagatggctcaaaattatcagactactagaattaacacacatgtatatatctcaggaagtgaattttagtgtccttgaagtcaaaaggattgtcccaaagccacccagaacaatggtgaagaatgtccctctatcgttgatgtttcatagcccaaatattttaagttctatgcttaatgcagagttcattttattctgaaatttatgagtgtttcaatttaacttgatctaatcatcaagtaatacactgcctatcatcagggaagtgcaatagagagctaaagacattgatattggtagactcagcatatcaacagtatttaaaatttaagtgaactatgaatcttgatatcttagtcgaaaaaggaaattgaccaaagaaagactatccggaagataaatgatttcttattcttagaaacaacaagtgagaaatctgagatggtatattagaaaaattaagataaagataacaaatgattgatagtagtcctcaaatatttaaaattttctcatgtaaaaagggggaagagtaaggagagaaatgagattttagaactaagtttcttttacttacattctacttcttgattcttatgaacaaactgattagcatgatgaaaaataacttggcaatattttatgtgtaagatgagtggagaccagaaaaataatgtctttctataatcattcattttaataatattctccatcccaatatgcaagaactgactcctagtaaaaaattaattctcacaagtttggttttattttctccccaacagaaaatcaacacagcacacataatctaaaaaatcattcattcacaattaagtcagttgccgttttctctctcttttttcaactgggtaaaatggccaagggtagaatcagttgaacgtaagagcatactgatatccaaacatatggcttttacaagcagtcaagattctctgtgatctgtgcatcaaaaatggtgaaattctgctgggtgcggtggctcacgcctgtaatcccagcactttgggaggctgaggagggtggatcgcctgaggtcaggagctcaagaccagcctggccaacatggtgaaaccccatctctactaaaaatacaaaaattagctgggtgtggtgacgtgcacctataatcccagctactcgggaggttgaggcaggagaatggcttgagcctgggaggtggaggttgcagtgagccaagatcacgccactgcactccagcctggacaactgagcaagactgtgtcccaaaaaaaaaaaaaaaaaaaaaaaaaaaaggaagtctgcatttcattactcttttcattgatttttctcctacttttttcacaacaacaaatcaaaattcaaccctttgtacctccaaactagttttagaatcattgaactcaatgaaacttaatgaaggcttcatttttcggtctttcagaaatgggacatttggagacgtttatgaaaaaaagtgcatgttttcatgtcctattgttatctttgtagagtagtgacttcgacttttctttggaattttttgacagacaataaagattatgatgcatacttatcatacaccaaagtggatcctgaccagtggaatcaagagactggggaagaagaacgttttgcccttgaaatcctacctgatatgcttgaaaagcattatggatataagttgtttataccagatagagatttaatcccaactggaagtaagttaatgttttcatttgagagtgtgcatattcatgtgagtgtctgtgtagtcatcactttttcatggaattttaatgtttggttctttacttcaaaatttgtatctgttagtttccctagaaagaaacgtctttgtgtgttcacatgaaatttaatttttgctagctcagagaaaagatactccattactgtataaagcatctcattttgtgagccttgacattgaaagaaaccaaatgagagatttgtaccgggaaaaaaaaatattgctgacattaggagaagcaagtcccaaactctattcagtgaactagtttcatttaatttctgaaagagaatctactaggactttctggaccaaattttccattcactcattttgatgcactcttttatcttttgtagcatacattgaagatgtggcaagatgtgtagatcaaagcaagcggctgattattgtcatgaccccaaattacgtagttagaaggggctggagcatctttgagctggaaaccagacttcgaaatatgcttgtgactggagaaattaaagtgattctaattgaatgcagtgaactgagaggaattatgaactaccaggaggtggaggccctgaagcacaccatcaagctcctgacggtcattaaatggcatggaccaaaatgcaacaagttgaactccaagttctggaaacgtttacagtatgaaatgccttttaagaggatagaacccattacacatgagcaggctttagatgtcagtgagcaagggccttttggggagctgcagactgtctcggccatttccatggccgcggccacctccacagctctagccactgcccatccagatctccgttctacctttcacaacacgtaccattcacaaatgcgtcagaaacactactaccgaagctatgagtacgacgtacctcctaccggcaccctgcctcttacctccataggcaatcagcatacctactgtaacatccctatgacactcatcaacgggcagcggccacagacaaaatcgagcagggagcagaatccagatgaggcccacacaaacagtgccatcctgccgctgttgccaagggagaccagtatatccagtgtgatatggtgacagaaaagcaagggacatcccgtccctgggaggttgagtggaatctgcagtccagtgcctggaactaaatcctcgactgctgctgttaaaaaacatgcattagaatctctagaacacgaggaaaaacagggtcttgtacatatgttttttggaatttctttgtagcatcagtgtcctcctgttttaccatgtcttttaccattacattttttgactttgttttatatgtcgttggaatttgtaaatttacattttttttaaagaagagactgatgtgtagatagaaaaccctttttttgcttcattagtttagttttagaatgggtttttattttatttccttttttaaaattttactttgcttttaacatttccttggggtgcttggacaaatctatccgatgggacaaggagcaccggattctttctcgggttctgcctagcatcaactgggccacgtcggccttcagagaacagtgcaacaaatgccagcattgccattcgggggaaaaaaaaaaaaaaaaaaaaaagatgagaagaacacttgttcataggagggccccaccagtcagagccctgaatctcttccttgtcccacctcattccccacctctacctttctaatggcggcatgatgtgtaaactctgtgcaggggtgggggcgggtctaactgtcttaacattcaagtcactgctcttcagaatacactctagacccaaaggtgtgctaatcacttcacagtgaccactacagagtactaagaagagaagatcaagggcatgaaattggggaagagtgttatttccgttttttaaatgagttgatgtacccttatatatatatacatatatatataaatataaatatatataaaaacaacaaaacaaaacaaaaaaagaaaa

SEQ ID NO: 24 - DNA, 117698 bp, Homo sapiens
gagagacagacaaacagcacaagagacagaaacaaagcaggcagcaccataggtagggaagtattttttttttaagtttgagaggcatttctgtagacagtccaacaactggacagacacgcaggcaccttggcaggtagacaggcaaacgacttgtcatctttgtcaggttcttcagagctgtgagttgctttctggatgcagctgatgggggttaatctatggttattgtgattctctttccagctgagtgtgggaattcagtcacaggcactcagggtactttgctgtcccccaactttcctgtgaactacaataacaatcatgaatgcatctactccatccagacccagccagggaagggaattcagctgaaagccagggcattcgaactctccgaaggagatgtcctcaaggtaaaattgatcgatttcagagtatgtgtgttatagtatgcaatagtctagtcaatactcactcctttgtctctgtgtgaatgatccaaactttctccttccttcctgagtcccaaaatactgtcctcactcatctgggagaaagagaggaccaaaagagaggggtatatgggtatctaagaatatggttttagagtttgtttagaagctgcctgctatcaaatgcatgtgtaattgagtatgggttgactgcataataaaagacaataatttagcttagggaacatggcaaagccccatctctacaaaaaatacaaaaattagctgggtgtggtggtgcatgcctgtagtcccagctactgggtaggctgaggtgggagggtcacttgagccagggaggttgaggttacagtgagccatgatcatgccactgcactccagactgggtgacagagtcagaccctgtctcaaaataataataataataataataataagttcggttggagcagccaatggatccagttttccattttgagccctgaccgtcaacatggatgatgaagagctcatagaacatgtatatatatgcatgtgtgtgttcatttgtgtagctatgtatttatggatatagatgcttttttaaatatgtttccacctgtgtgtgaatcggtgtccatgtatttatttggttttggggatctgtgtctgtgcatacctgtgtcagcatattgtgtgtatgtgcacttgtgcattgtgtatgttttggttgaataacaggctattgcagtagcttcagtgtactacgatgatggcctggtgtggcagtggggttaaagaaagtgagtttgagacatatgtaagggaaggaaatgataggacttggattacagagaaggtcatagagagggatttgttaagacactgagcatatatgtcttatgtttctttgcataaatacaaagaatatgtgattgagtacctccaataatgtgtggtgtatgtctgtgtaatcacagagttgagcgtggagaatttattaaagagctgccttaataaaatgaatgataaggaaagcctcatacaaagcatgttcattttcattctaggccaaggaatttttttagctttttctaatatagttttattccttgtagccagagaagtccttacattggaaaaagttgaaccagagcccactactctggaaaatccaaagataaaccattaaatttccatgctttcagattatctccagatgtgataaatgtgctgtcctttttatgtacagatgatggatactcttggccaaccccctggggcatatgtcctctggggtgtatggtgtgtgtgtgtgtgtgtgtgtgtgtgtgtgtgtgtgtgtgtgtgtgtgcgcgcgcgcgcgtgtgcacgcgtgcgtgtttgaaatgcatttctcactcttacctaatcctttttgaacccaagaagattcactcatgagatcactggctgggactggatgtgcctgaaatgggatagaacaatctcattggcttcttaagctctgctttccaaccccacataaaaacagtgtgtgtctcccaacaagagaatacaagacaagggttttatgcccttccaataaccatgtctttaggcatcacccttgaccttcacttccctccatccatttgagtctcagagggtgcaatcagtacagcagcaccagagggacctcctctctgtagaggtacagatggagtaacgcaagctgggcaatgcagaggctttcttggatgaaggccattagcacaaaaagccagctttgaggcatagtttacaattttcaggttttgaagggagtataagcagtggttctgtgcaagtgacctgatagagccagcagaaatggctcccaggttgctggaggtcatatggagtatggccagtgcccatgcttcctcactaagggggtctagattcagaatagcacctaagacatagtcagcaggtgtgcacactcaacggcaccgtcagggttctggcttcagggtcaggtgggcagctcagtagataagcagagagagtctttctgaggtggtcagggtaagaaaggaggagggacatggggcataaaacctaggtcagagttcagggaggactaacagaggatgcaggagcccaggtagtgcacacacatacgtgcacacacacacgcatacacaaacacatgcacacacatgcacacgcacacaatgcacacacgcacacacacatacacacgcacgcacaaacacatgcacgcgcacacacacacacgtacatgcacacacacacacactctttagcaccagggtaggaaatgctcctgctacggcctctttgagtttagctcctctgctctcccttagagactgctgagtgtttccattcccaatttccattttccctctgttgtggtgtgccaacaagaaaattaactggatatgtgtaaatattcagtagatcagaagaagaagacatgtcttcggaatcagagctaattgcccctctgtaggcaacgaagaacagagacatactttaaaagctcctaatttgtattcttaagagaatttgagagaatattatatttatgacacaaaaataggcaataatgaaaacagagcaatctgagatgaggagagattgaatagagatgaaaaacatgatcacccaattaaaaaatggaatggaggcaatgaacggaagatggtaaaccacagaaaaatgaaatcagtttattaaaagataaatttgagaatttctcccacatctcataaggaaatgaaaaagaggattattttatattaataaaatggataatcaatccacagtaaaactttatgtgccaaataacatagcacgaataaattaaataaaaaccgctggaaatgtaaaacaatttaataaagttacagccatcatggaagattttaatatacctctgtaagtctgtgacatatcacctaacttaacgataaataaagatttgggtagcttgaataatgtaacataataaatcagaagaaagtaggagaaagatacttttaaagataaaggcagaaatgactagagaaacaaaactaaaaagcaatagcaattgtcaaccaaaccaactgttttttttttttttaaataataaagtagacaatactagcagaactgatcaaggaataaagaagccacaaatatgtaatattaggaattgaaaagggacataatcaaagatataggagagattatggaaataagaaaatgtttagggatcacgccactgcactccagcctgggcgacaaagtgagaccctttttcaaaaaagagaaggaatgtttaggaacaactgtaagccaagaaatctgaaagctcagatgaaatggaaatttttatagataaaaagtactaatattaaaaaaaatctgaaaaaaaaacaatgaccattaaaaaattatgattcccccgtatcctctctcaaaagccccaggccttaactattttacaggtaagcttaacaaaacttcaagaagcaattaatccctgcaataaactcttcagaagagagaaaaataaagaaccatctcccaactcattttttcttaatgaggcaagtagaaactttggtatcaacgagtaaaattatggttaccaggggattgagggaatggggagataatggtcaaagtatagaaagcatcaattagacagaagaattaagggtttctttttcctttgagatgtattgcacgttacagtgaatatagcaaataataatgtatcatacatttcaaaatcactaaaagagtaaatttcaaatgttctcaccacagaaaaagataagtatttgaggtgatggttatgttagtttgatttactaattccacatcgtattcataaatcataacatactttctactgcatgaatatattcagctataatttatcaatttataatttaaaataaaaattttaaaaagaacagaaatcagaaactattagggcagtctcacttttgatcacagatctaaaaattttgagtataaatctgattgaatttggctatgtattaaaacaaagatgagaccatcctggttaatacagtgaaaccctgtctctagtaaaaatacaaaaaaaaaaaaaaaattagcgggacgtgatggcgggtgcctgtagtcccagctacttgggaagctagggcaggagaatggcgtgaacctggaaggtggagcttgcagtgagccaagattgcagccactgcactccagcctgggtgacagagagagactccgtctcaaaaaacaaacaagcaaacaaagacgaccaagtaggtttgattccaggaatgtgaggatgtgtcaaaattagaaaagctcataatgttatttgttagacaaaccatatgaaattgctatttttgtaggtcaaaactgttaaaatattggcaatttcatggctcaacctaatagcctataaacagattagcaaagaaaaagacattatcctgctaatacaccccaaaacatcatgtgattaagttcaacacccactcatgatttttgaaaacatctcataaaactacaaatagaactttcctaacttgataaaaatatttctaccaaatgcctatagcaaacattatacttaatggcaaaacttcctaaagattttcagtaaagtcaagaacaagatcaatagttctactatcaccaatagaacgcagcattgtactgaagagacaaaccattacatttataccagaaaaagaaaaaaaggaactataaaaattagaaaggaatatagaaaattgtgacttttgtttcaaaaatacaaaacaatcaactaataaactcaaaatcaataagaaaattcacaaagcttctggtgtttctataaccaaataaaacttgcaatcaggagggaaagtctcatttataatagaaacaaaaactgtaagacacctagaaataagccctccaaaatgtgcatgatcttaactgagagaagataaaattttattttgatattgatgtaactaaaataaatgcagggagatttcattctcatggatgcacagagggtatgaaaaggcaggcaattcacagaaaaggaagtaagaactgttgataaacataaaaagatgctcaacttcaatggcgatcaaggatttacatattaaagtgagataccactttacactcatcaaattggaaaacatcataatgccctaaaataccaagtatcagcaaggatataaagcaatgaaagctgtcagacgttgctggtgagagagcaaattgctattccttttcaaagagcaatctggtaatatctaaccaaattgaagatgtgtcatccccacaaccagcttttccatgctagatgtatgctctagagaaactcaagcacacgtgtgcaagcggacatgcaggaatattcatagaaattatgcttacattgtttgtaattgtgtatagaaagctttctgcttagcatattcattttgaaaccagccatcttgctgacctgctttattggatgtaatggatgtgcatagattctcttggatttctcaatcacctgcacataatgatgaattggaccatcaagcaatattctgttaggaaataaatgtatacaaaggcccaattcccaatagcaatcaaaaatataaaaatacccaggaataagaacagaatggtagtgagagacataaaagacattttgattaaatggagctagacaccatgtatatggattggaagactcaatatcacatagatagatttttctcaaatccgtctatacatttaatgtagctcagtcagaattacacaagttttgttggggagttttttgttttactttttataattcaggaaaattcttgagtttagaagagtacatctgggagaattttgtttaagttaaaagaagacaaatgaggacttttcctactaattatttaaatatattgtaaagctacagtagctaaaacagtgtgggtcatgcacaggaatagacaaatagacaaatgcaatagaatagaaagttgacaaacaaaaccaaatgtatataattatatgttaattatatatgtgataaagactgatttgaaattagtagtgtgtggaatatttacaaacagagtttggttaaatgactaatctatcagggagttaaggtagaattgtatatcatatcccaaaataaattccaggtagatttaacgacatgaattctagaggaaaatattggtttatttatcatacatttactgagtgagccttatgtgccagagcatatattttgggcgctgatatgtaaataattatcttgcagattgggttaatttttattatagaaattcctgccaccatttaaatgctgttatggaaaaaatatttaatgactttaaaaatatacacattatattaagtgaaagagcagtttgccctatagtatctataattcgatcttattgttataaaaaattataaaaacataaatttatgcaaggaaataaatgcatagaataaaggctagaaggacacttaccaacatgttgtaagttctgaaagttatttgcacatttctgttttataagtttttctgcaattaatattgtaatgatgcaagtaacatttttgttcttgatgaattaggatgaattatgcttggaaattaaggaaaatatcctgttcccatcatactttttattaattaaccataatttcttaatagcatcatatatccagtgagggtttaaatttccaattatctcatagatgtcataatattttttaaatttatagtttatttgaatcaggattcaataaggtccacacattagattcattgtctgatgtgttttttaatctgtaggtttctccctccatctcttttcttttcccccttgtaacttacttgttgaggaaatcagatcatttgttcagtggaactttccactctggattttgctgaatgcactcacagggtatcatttcgtatgttcctctgtcctcggtatttattgcctgtaagttggaaattggatccagtggcttgatctgatcaggtctgattttttgggcaagataactccatgggtgatggtatatcttttattaaagaaacacatggtgtctgattgtctttcttactgcaattgatgattattatttcttattgcaattgatgattcctagtccattgatgataaatgccttggtccattgatttccatatgtttcggtgattaaaaatatttttgtaacaatttaagctaaactctttgaacttgtattatcttgatgtctgttggaaccccagaattcactcagtctatcagtgatacacagcaattacacaaggatctggaaacagacttcaggctcccaggagcctaaacaaatctctgtaatatacaacactgttagtttgaaggatggcttcttttagaaagctttgcttcataaatagtacaatggaaatattgtgccaatttgctggcagctggcatcacattgtgtgccatgcacaaatattcatcacccactcagagatcccatctttgatatttacaaaagcaccagggggtctttcactcaatcacaacttctgttgttatttgtacaattatctggaaaggagcagcaaccttgaaacctggggagccagttcattattctgatgattgttgtctttgctggtactaagaagttcaggggacagatgggagtgagggaagccagatgcctgtacgattccacccttggcaagcccagcaggccctagctggagccctcattttaggagggaaggggcagaggctgagcttggggaagaaaaagtcaccatgacatgctggtgtctggatcccagggatgatgtccagcagagtgctcaagacaggctactgccacagtggggtgggatcaggtgagaggatggctgtctcatctactggaaggacaggattgagggtttagcaatgtagagatgaatgctttcagcctgtctctctgaagaaacagatggtttgacaagcaggcaacccaaacctggcctccccaggctgctaaagagtaagctggtgctatatgggcattgcgggaacaagaacaaatctccactggaaagattagaatagcaatgagttcccaaagactagattcacactaaagatgggctgagcatagaactgacatcaagggaaaacgagataacttgctcagttgatagcttccctctgccatcttccttgcatctgataactcactgtgcctctgatagttgttaccagtgctaaactccaggagtgtgggttgtggggtaaggaggtgttgttcaacataaggccatgctgacgacattgggttgggggtctctcctgtgtccaggtttatgatggcaacaacaactccgcccgtttgctgggagtttttagccattctgagatgatgggggtgactttgaacagcacatccagcagtctgtggcttgatttcatcactgatgctgaaaacaccagcaagggctttgaactgcacttttccagtaagtctttcttgcatctgtgtggacaaggaagtcagggtttcccattttattcatttatttgagcttctgcttgctcacgagatacaaagaatgtgctcttaagactgttttaaaatccaatatgtatccatcagtggatgcatgggtaaacaaaatgtgatatgttcatacaatggaatagcatttgtccataaaaaggagtgaagtggccgggcacagtggttcatgcctataatcccagcactttgggaggccaaggcgggtggatcacgaggtcaggagttcaagaccagcctggccaagatggtgaaaccccatctctactaaaactacaaaaattagctgggcgtggtggcgggtgcctgtaatcccagctacttgggaggctgaggcaggagaattgcttgaacccggaaggcagaggttgcagtgagccgagattgcgccactgcactctagcctgggtgacagagcaagactgtctaaaaaaagaaaaaaaaaaatggagtaaagtatacatgctttgacatggatgacccttgaaaagattgcagtaagtgaaagaatccagtctcaaaggccacatattgtttgagctccatcatatgaactgtccagaacaggcaaatccatagagccagaaagtaaagggcagttgcctagggctgagggagttgggggaaaaatgtgtatggaacttctttttgaggtgataaaaatgttctagaactgattatggcaatagctgtacaactctgaatctactaaaagacattggattgtacacattaggtgggagaatgtatggtatgtgaattgtatctcaataaagaaagctattggggaaaatcatgcacggagtatagtcaggtttcccctcgtctgggctcaaggctgcctggcagaggatccttgcctgttacagcaagaggttcagtggaagaggattagagacacctttgaattccacttctatcatgtgaaaattgtgtaagtttggaacaatttatttaaccttcccaaatcaatgctctccgttgtaaaatgcagataattatacccacctgtaagactcctgtgaataacaaatgagagagaacacatgtatagcgccgtagagtgggagctctgcataaatctgtttccttttccagcccatttcaacagcgtatgtttaagcaggtcataactcagcttttaaacatacatttaaagtgacttctccatattacaccatcttatcagaatgtctcaataagcaaaatgaaaagaacgctcctgctagcaaaaatgctacggggtcaaacaaaagaaatagaaaatgcagaccttaggcctgaaaactattaaaagcagaaatcatttacatatagcaacagagaaatggatgttccttaatataccctcaactgagcatagaaatgaggaaatcctgactggtgaatccatcagaacccagggtccgtggctgagacagcttccttgaggacgtgggctttgagggaagagaggaagcatggtttctgccacaataggtcttactcactctacctcttctctcctcaccaggctttgaactcatcaaatgtgaggacccaggaacccccaagtttggctacaaggttcatgatgaaggtcattttgcagggagctccgtgtccttcagctgtgaccctggatacagcctgcggggtagtgaggagctgctgtgtctgagtggagagcgccggacctgggaccggcctctgcccacctgtgtcggtaggagggctcttcctctgcagggaacccttgggtctcccataataccaagctctagtcctggtctcattccagttagaccccatgctccagggcctgggggccatcaacttggactgaatcctcttgttaacaggcatcatggttcacctgcaccccttctccacttcctcactttcacacctcattacacccatgcagcagtgcagtcaggcgggtggcttgcctttgtcgcacatttagcaagtgggaccacagccaagtcatgccctcaaaattgtaacgcgggtgatagcgatgaggtgggagagtccattagaaagggagagatggggcttttgcctgagttccagggcttatcgtaacgccaagactcaaatgagtctcccacccactttaggtctcagtttccctataggtaaaatggggctcattctccctttactggaggaatgtcaaaagacatagtaagataaagaacacccattgctctcactgataaagaatgcaataatgaacttgcatcttcttaaacctgtgattcttccagaatgtcatcagaggttctctagaatctttacacatgtgtcacaggacaagagacagtgatctgaggcagaagtgcaaaataggcaaaattggttgttctgtttggccttttcatctcttaccacccatctccctgctaatgtgagttcccccatactgcttcgtcctgcctcctacctttccaaaaccagatctgtctctctctccacccccttccccatgtcccacaacctcaacgtgtctgtgccagcactggctaatcttgtaagaacaaaacctccactggaaaaacacatacatgcctaccaagccccacatgccaaaattggtgcacatgtatgtctgggtatttgtggaggcagagaaataaatgaagaataaaacctgttcactgcccttgtcagggcccatactccagcatggagaatagacacataaacagataagtataatgtaagagaagcactgtaaaaagagttaagtgcaaaatgttgggaggatatgagaatgttttgcatgggaggtgatatttcaattgagacttggaagaatggattagaattcaccaacaggagggagaggaagggaggttgacattctagactgagcacgtgcaagggtgaaagtgtgaaccagcatggtgggaagtgttaaaggccacagatgcttttcccctagacgactacattttcacaggatctttaacactgttatacaatggagggtctaagtggaccctctgcaagtggacagaccgaaacagtagcctttatggaacctctagggtcttcctctccctttgcctttgacctggtcttcaggcatatctcccctttcgccctccatctctttttatatctcccctcattcatgtgccaggaactatgctaggcactaggaatacagagaagagcagatctcaggccaggaagggtgatgcttgcataaacacacaaccgtataatgccacagacaagcaagccagagcacacaaaatgaaaaggagggatgatgactcgtattacaagataattatttgctttgcagaaaagattcactgtaagattactttgaatatcaaatatgccagttggactggacttattgggttcactcaagcagtataagagcatttaaacttagacttacactagaaccttggaggccttccccattgagactgcctctagcctgctaggggattgaggctgtgtatttgagattatgtgcatatttttgtatatgtcatgttgtggtcgacttcatcatggtctaccacaaatgactgctatagcttaaaacatccaaatgttttattcttcggtgagtggactctgcagcccaaacaaagcagccaagactcaagggtgggaagaagggagaagaccagaaagagtagacttacatgttctcaatgttgttgaatctgctacatgctggcccactcagccccctcctgcccacctgccaggccccaggtaaggtatctagttgtccatgatgacatgttcccagtgctgctgcctccaaatcctcacttcccaggaagcaggaggtccttctctgtctggaatatggaaggaagctctaaccaaggacatggataatgccctcccacctttctagctacttcctctatttgtggaaccagtcaagcctcctccccacaattgtagtccatcctctcaccagcaccctactccctgccatgggtccattcagcctggcatctttcaatcaggttggcacctcccaccccaacagcaccttggagagaagagtgaagcttgagcagagggtcttgtagagggcctctcctgcaacccttccttagtggtcctgtgtgaaaccaacgggtccatgaaatgtttgatgtgtcctttatagcaacaggtaggggtcagtcttccatctgtgaccctgatcccttcttctcctatttctagcatcttgcctaatcaactattccttttcctaaatagctctgcaatgaacatcctcctcttcatttgtactcattctcccttgattcagacgcttatagtaatttgcatggaaagcaataatctgcttccattcatttgattgtccagccatccattaattcaataaacgttaagcatctataatgtgccaaacagtatactaggtacttgatgtgcagatataagacaaggtccctgctgccaaggagctcttagtcttgtggaggaaatagacatgattttaataacatgttacacatgctatagtagaaatctattcacattgtaatgcagacacaaaggagggcagtgtcagttctacctggggaggggaggtatgtcacaaaagatgtcacagcgaggatgtttattcaggtcctccatccaaatagagcttgtggacttcatcagcctagaccaaagagttcacggaggccaaagggagccactctggtgggctcagtgggctctactgaaaagtttagacttcatttggggagtgaatgcaagcagtgacttgtttgcatttgataaagatccgttgatggcactgcctagagcgtgggcaactctgccagcctagagattgtgagggcctgagtcaagactccagcaatgtgggcaaagtagagtcaaacatgaataataccacacaggtttagcgactgggtctcagaggcagattagatgtcggggaggaaggaggagaacaccagcaggaacccccagcttctgacttcagtgactgctccaatggggaatgtagacctcttcacctgcctccctgcctccagtttcacccctgctgtaccccatcatactgccaccacagtgactcctcctaacatgcaaagttcactgatgtgtcatgcagtcaattaactcacatgtataatcactgcaattctttcctggaacagtgaatatatgacagcctggtatccaaggtccttcaacctgtgatgcttcctcacctttccagtcccatctcccccatctccctatctcataccccagcctccagcctgccatgctgttcctcacctccaggaactttgcagttactcttctgtctctctctgcagtgccctccttcccatcctacccttgccacccaaccgacctggtcaactcttgcttctccttcaaggttcatttaagaccagcaccctccctgaccctcgctgtcctttgctcagggagattggtcacttctgctgctacttgttgttaggatacctagcacacagtgtggctgtcttctctactagacagtaaactcttccaggggagggcagtatcctgttgatctctgctgtcctggcagccagcagaggtcctgttgctatcaagaagcaggttgaagtacttgcatgttcctccctaggaggctttgaggaggttggtcacagaacaggcaatcagccctacactcagggaccatttttatttaccagtgtacaattcagttgtttgtagttatattagtctgttctcacactgctgtaaagatactacctgagactaggtaatttgtaaagaaaagaggcttaattgactcacagttcctcatggctggggaagcctcaggaaacatacaatcatggcggaaggggaagcaggcaccttctttacaaggcagcaggagagagaaaagtgagagaaggaggaacttcataagttctgatggaacttataaaaccatcagatctcgtgagagctcactcactatcatgagaacagtatggggaaaactggccccatgatccagtcacctcccaccaggttcctccctcaatatctggggattacaattcaagacgaaatttgggtagggacacaaagcctaaccatgtgagtagtatactcacaggcttgtacagccatcaccacaatctaatttttgaacattttgtcccccacaagagaaaacccatgcccattaacagccactccccgttgtccccttccccaggccctggcaaccactaacgtaccttctgtctccaagatttgcctattctaggtatttcacataagtggaatcgcacaatgtgtctgacttccttcacttaactaatgttttcagcgttcatctatattgtagcatgtagcaagccttgattccttgttgttgttgttgttgttgttattgttttgagatggagtttcgcatttgttgcccaggctggagtgcaatggtgcgatctcggttcaccacaacctccacctcctgggttcaagtgattctcctacctcagcctcctgagtagctgggattacaggcatgtaccaccacgcctggctaattttttgtatttttagtagagatggggtttctccatgttggtcaggctgatctgaaactcccgaccgcaggtaagccacccacctcagccccacaaaatgctgagattacagggatgagccaccatgcccggccgccttgattcctttttatggttgaatactattccattgtatggctatgccacattttgtttattcattcatcagttgatagacatttgggttgtttccactttttgataactatgaataacgttgctatgaacattcatgttcaagtttttatgtgaacatgttttcatttatcttgggtatatgcctaagagcagaattgctaggtcatatggtgactatgtttaacattttgaggaaccaccaacttgtttttgaaagcagctgcaccattttacatttccatcaataatgatgagagttccagtttctccactccccacctacgcttgtatagtctttttgactatagacatcccagtgggtgtgaagtgatatctcattgtgagtttgatttgtatttccctaatgactaacaatgttaaacatcttttcatgtatgtattggctatttatatatcctctttggagaaatgtttattcgaatcctttgccttttataaattgggttacttgtctttttattgttgatttgtaggggttctttataggttctggatataagtctcatccagagaccttttaatatgctgtgctcaatcacttgaaatgaatgggagagggaagggactcaagagcaaacaggcaaaaggagccactgagtgactgctggcagctcaggccaccccatgaagctcactcttttgggatttctttcagccgagtgtggagggacagtgagaggagaggtgtcggggcaggtgctgtcacccgggtatccagctccctatgaacacaatctcaactgcatctggaccatcgaagcagaggccggctgcaccattgggtaagtgtcagggctgacaaagtaactatcgccagttgttcaggggagccatcatcagcatcatcaccaggccatccagctagtgcctggcctgcctgcctcacctggagaaccttgtgatcaatagtggttgctatactggatgccttagaaaatctagaaaggtcagtctcagcctctcagggcttcatgccaagtccatacacctcactggcccagatagcacagttacagcagagtagccgagggcatggattgaaggcatgcagacccccatttgaatccaacccttccatgtactgtttgcaggactttgggaaagttccttatcctctctgcatctcattgtcctcttctgtagagtgtggatctcaggataaagcacttgaatgagatattgcatgtaatatgctcagtatagtatttggaacatagtgaaatatttaataacagttgctgtggttatttctgacagttagcaagcactaactcagctttagctgtatggcccctggcagattgcttcccttttttaggctgtttcctcatctttaaaatgaggacagaaatgcttgtattttagagttgtggaggaagtaaatagcaaaagaccagcagtggtatgtacttcttcaaaagataaattccttcaaaataggtatgccatcaaaatgtaacttccttccaggcattccttattggaatttcaaggagtcagaggagaaagaaccatcaccatttactgaacacagagcctaccttattaactccctgcaatagccctattgataataatagtaagccctaataacaaataggcattattgtaattcccattttatagatgagaaaactcagattccaagaggatgcatagcatttctaagtttgcacagggaatcaaaactctgagatccgaacccaggtctttctgaatcttcacactattgcactgctggcaaaacggggccttgagccatggctcaggtgagttaggaggaaaagagcaggttggggtagcagtatgagcggaggtatgaaaggaggatagaacaagggaattgggggggaaacagtctggctggagtaggggaaacacatgggtaaggaatgggagatagataggggtaaagtatagcctggttatggaccatcttaaatgccagtaactaagagggagccatggaaggttcttgagcagcgtcggtccaccagggttatttgcagtgtagagagctcatggggagacaccatcaggagtctgttacaatgatccaggaagtaagtgctaaggatttggaatagtgaggagccaagaaaaggaatagaagtatagctaggagaagattcctgcatgtaagagtttccaattaagaagaactggctgaatgggtgttttgctgcaagaaatatagatattcacttatgtacacagttcaattaatgttaaggaaatgtattaagtatttaatatgtacaaattttttagctaaactctgaggaaaataaggtcagcagtgtacatagggactttgcattgttagggaacaagttaaatatgcacattcatcctgcacggcactgctgggataaccttctgaaagcatacctgatcaattcaccctctgatcagaaaccggattccatggccaccccacgctcacagaataaaagctaaacattttattctggcctttgaggctacagcgacttcagcctccctccccaaccttattttccacttctcttcaatgacattccggcaaagcaaaattattggtgacccctgtacatggcctagctcagggcctagctcagggcctttgtttctactctgcccttcctctggaacgccctcctccctccaaaggcttacatctaaaattatccatccctcaaagtcaagtgcaaatgtcagctcacccgggaggtcatccctcaccccctctcttgcggggctcctaggagtcctttctgcctcttttgaacttccattacctgttgcatatattttcctgatgacactgaccacttttctcctttatttatgctcatgccttacctcccctcctggagctgtggtctctgcctgattcatctttgcaagtctcccagctcttagcacagtgcccccggctcaacaagtgtcaagtgtttgatgaatgaaagaatgaatgaagcaagacccaagtataaaggtagttatatgcctagtggatctatgatagttcctcggtgactagtggttgaacaatgagtggatcgagaacataatgactatttcactttagtatacacatgtgcaaatcaagaggttttcccactttcttcacttggagcatcattcattgatgcattcattccctcatattcacaaatatctgtttgtttactacctggttgtgcctgtgccagatgctggcattatataaatgaatgagatgtggccatggttcacaaagagcagacgcacatgtctgtccagaacaaggtggtggcacaatgaggaaggggaatgaaaaagcaggacaggaggagatgggagaagttattctggaaaaggtgaccctagagctgagtcctgaaggaaggagaggaggttgccaggtagccaaggaggaaggtgggtgggagggtaatgggcctctaggcagagtgaagcagtgtggtcagcctcaaggagctggaaatggttcccgcagctggatgatcacctgcgatttggtgggtggcggcattcatgggagatgaagctggtggtggaggctgtggggagcacagagggcgttggggctatgaggctgcgttttgacagctcctggcagtttggaggagaatgggcggagtgggacgggctgggccggtaagcgcagtgaggaagctgcctccagagtgtggctggggacgaggaggccagaagtcaggcagtggcagtggagatggagaagaagagaaaattcaggggacattcaagtgatcacaccaacttttctcaactactgtttgtgacaacaatacaccaagtacccgcgtacctaccgcctacacccaaatggcgttactattttgccatatatgcttatgtgctttctttgttcttctctttccatccttttgttttcctttttgctgagctgctggaaagtacactgtcaacatcatgatacttcatttctagatgctttggcacacatcgtctaaagagaaggatgtgttcatccatggcatagcggccgtaatgtacctaaaaggcacagcattaattctctgggaattaaggagagcagagcagatctaggtgtggctggcacaaggaaattacaataaactgatgaatggatttctgggcagtagtgaggaccattttcactgatgagaatggtggctatgggggtggaggggagacaggaggcgcctttctagccctcaggaagacaagatcaaaaccaatacaggaaacgtcctctccagagtaacatagcaagaaatatgaagtcatggggggcatgctgaggatcccaaaatgggaagaagaaagtaaaggtccaaagaaggtaaagataacatcagtccttagtctggatggcttcttggagccacagcaacctcaaaggagctaatgtgaagtaagaagatgtcttcccagtttcactgagagctgcagaaagatggagatagagtggcaagacactgtcccttcctcattctcccaccccagtctgccatcccagccagtatgcatagcatgcacacgtacagctgtatttatgtgtgctcactccgtcctccccctttctctccccttcccttcttctttcccactccctctctccctctcctcctctccttccctccttctttcccactccctctcttcctctccttccctccctctctctctttttctcctctccctccgcctcaacccccaacacacacacacacctgtcttgaataaccagcagcaaagttaggataactcacactcataattagacaaacacaaaaagcccctttgtgtttgagtccttatttagttattatcttttttattagaaatatctttatagaatttttctatatacaaattaggtactcttttttttggaggagggttggacagtcttgttctattgcccagactggaatacagtggcactgtctcagctcactgcaacccctaccttccaggttcaagcagttctcatgcctcagcctcccaagtagctgggattacaggcaagcgccatcacgcctggctaatttttgtagagacagggtttcaccatgttagccaggctggtctcgaactcctggcctcaagtgattctcctgcctcagcctcccaaagtgctgggattacaggtgtgagccactgtgcccagccagataatcatttttttaaaattcaaaatttaaacaaatttataaactcgaaatgaaacgtttccacaatcttactctgtaatcttactcctcctcacaccccacataaaataactattaatgtctgtctgctctacttattcttttggatattttgtgtgccaatatgtacataaagcaaatgtaatgcacatgtttctaaaccaagttcatccacatgcatggcttagtagcttgttttctgttttacctcttaatcatatgtcaccatctcatcatgtcaatgtctatagacctacctcatcctgtttgatgggtacagagaattctattgtatgtaccaccataatttatttaactattcccctgttgaataagtgaatcttttcagcttttcactccaacattcttattcctgaatcttcgaacagttgtccatttatttccttaggatatatttttaggaggtaaattttgatacatgacctcaaattttcttctagatattatagcaatttacaagtctaccagaagtctatgggaaggcctgctaccccacgcagtatcactagacattgtcaatactttcagtcttcaccgcttagatggacaataggatatttaattgtctttgctgtttctggttctttgtgtgttttctgtttggacaatttgtctttttcatatagagtgttcaactgggctcatttctagtctataactcatttaggtttctcttaaatccaataatatttaagaattttttcagttactaagtggtttatagatcttgtatgcttttcattatttttattttgactgcattgtgcctttttttacttttcaaactttttgttttatttatgttccatgggcattgaagaatatgaaatgagtacaaggggctatatttcttttacataaaatgtattatgctttctttcaaacagaatacattatgcttctatattgcttttttttattgttaactcttcctgttgttagctgatctgctttaattggctttttgttctagtgatttcagagttctatatcctgtttttattttgccagtgatcttgtgttttcattaattcagttctcaacagtaattatcctgttctttaccctctttttgttttggaaatcttgcttttgtttttatttcaaggaaactaattttctgtttctagactgctcttgacagcctacttttgtttttatcaatatgttatcatcttgtatccctgagaatactatttgtgttttgttttacaatggttgtcagtttttccctgtgtcaactgcattttgcacttgagccatttggtttgattattcagctggattctttatgtcccatgagttttattgtttattcactatcaagtcatagctaagcgctggactctggtaccagcctacctgaactcttatttgctgtgttgctcagggaactctttaagccctctgtgcctcagttctcttatgtttaagatggtaattaaagagggtaccctccttaaggttgctatgaagattgagtgaacatatataaagcacctagaatgtggctggcttgtaattcccaaatgatgagaactcccacctggagctaggtggatagttgttcattttacccaaacagagtattcctaagcacagcaggctgtaagtcacccctaaaggatctcaggtggtgggtgctgtactgtgggtgggagcatgtgtgctaggtgggaagggacatgggctaggcagcaggctagccgatgaggctatttccaggggcacagacaggagaaggcttgcagatgcatctccctaccctgcttcagccctgatccagcactgagggtgaccagagggatctgtagccaggtttgctccagcaagctgggcaaggatggtcccttcccaggagtgcccaagaggcaaagtagttggctgcaggaatctacagtcaggcttacccttgggtgtggtccaagctggaaaatgggtcctgcctggatgtgtgtgacaagagtggaatggaaggcagcccctttccttgaaccctggtaatacctacagcatctggcaagtgcttcttcctaagtgccaagaatggggtggatgagccaatgcactccatccaggcctggcagctgacagcaggagggcagacccatgagctgctccctccctgtcacccttgcctgtgtcatcagtacatagaacacagaagtttcatcctataggagtggaaactcttctcagcttctggtgttgagctggagggttttgttttgttttgtttttaataatcagtgggcgagctcagatgaaaactggaaaagaaagggagggaaagccctttgctcttggttctgcccctctaaaacattcatcaaatacctatagcacaccaggttctgaatcagttattactgtccccattttatagatgagatcatcgaggcccagaaagaatgaatgaccttccttgagatctgacaattacccagtaatgtgggattggaacatgttccgtctaatgtcagtctttgctctttcccatctgccattcaggctgtggtctgattccatctaacaaaatatgcaatgattacctgctctgtgccagagactgtgtgatgctgtgcagtcggaaacacaaagtccagaccaaggccaggccttgtctgccaagagttcacattctagtggggaaatagtcaaacagacaggtacctccaagataaaatagatgctataagtgcaagccaagtgacggagttcagtaacagagaagagagagaggagttctgcctgggactgtagaggcaatctttccagctaggggtaagagagcaaaggtatgaacataggggaaaatacaggatctggccacgaaagggcactcacttgacgtggctggagctgcgtgcatgtgggcaaataaggctgtgtgggtaaggaggagtctttacacactgaaggccaagacaagaactctgaatggatttctcagtataataaggagctgttggaacactttaaagacagtaacaacattcagttcaatttaaaaacttggagcatttactcagtgctgggcattctgccaggcacgggggtataaatataaataagaaacagcttttccccttgaaggtctcagtattatagacagaaattatatcagttaggaatgaaaatagaaaaacggactaaagctggcttcaacagatgggggttcatttttctcctggaacaagaatctgaaggtcccatccagacttggtaccgctgctcaggaagccataaccttccttcttggtctgccatcctgaggctttcatcctcgtggctacctagttggctgccgcagctccagacattatgtctgtgttccagtctaaaagaagagggaagaggaaagggcacggagctctctcctgatgaaagtttgcttgtgtatttgggaagaaccactatccttagagatactgtcctacatctcattagtcagaacttgccatgcctggcagggaaaaagtgggaaatcaattttgctttgcttttagagcctcaatagtagagagatgagaggtttggaaatgaagcacagatcatccaacccacagtttctgctatagattctaagataatgtgatgaatgctatagtggaagtatgcacgaaacacaatagaaaagtgtctgcgaggacagatcataattctgtatggcagttgggggtggactacagggaggaagcacctttccagctgcactttaaagaacagtaggagctcaccatgcagggtggaggtgaggccctcccaggcatgtgaaagggaggaagatatgaatgtacacagctgcttctggaagagctcattgtctaggggggatatgaggacttcaggaagatctgtggcagcagtgcagaggataaattggctgggaagccagggaggagcctaggagcactgttgagggatcctggttatattcaaaagaactgagtcatttcttatgcgcaaatgtggttcgggttgaagctacggttgtctggcttcgtggagggggaaggaagaagggagaggagacagtcctctgccgatgtgctttccctgcagagatctgggacccatggaaggtggagaacttctcactctggacactcggatttctgctatgcccataaagctcatatttggctaatagtccttgttttttaacttcagggatacttcttaatgattaacacacagggaaaactgaaaactccattcttggattttggtcaccatgcagcaggcattggcgggcatggttttgattaaccaggacccctgcccagtggagcttatcttcctgggaggatgctgggctagaaaaacatctggttgtgcctgaagcctggattcccttgctgtcgtttcagatcagtcacagggcagcaactccccacagtggtcagtgttgcctccctccagccagcaagtgggcagctggcccagaggaggcagaaggcaccagaagtgaagcttgcattcacagctcttgccaggaatcatggccacaggttcagcagcttccagagggtttatttctgagcaattatagcaagttaaaccttaaacagagaaggttcgtgtacttacactgcaagagctgatctcctaaaggaactgaacagagaagcacacacacagtggggtattcctttgtcagatttaagtcttcaacaaattggagaatagccaaaaggaatgtacacattttttgaaggagaggatgtggatagcctggaaggtataaatgaagctttgagaatggtggcactctccggccattcagtttttcatagaacacctctagagaaagaaacacaaactacttcaaattatcctcatacgataatctaaccgagctacactgagtagttgaattggccagaatgcatcaacttgactgccagtttaagatcccaaaactgaattccaacatctcttaggaggaaaataaactattcaaccaaagaaatgcacgttccctgtgggttgaccacactgaaccagtatagatctctccctttccaaaaataagtaaagaaataagcaaaaagtacataaaataaacttgtatgatgccacttaaaacataccactcattaaaagagaaccatctccctaaaaaaatacaaaatttttttctaaacatgttttactataatagacatgaaaatttaaatggatatagacataataatctcatttaaatataagaaatatgcatgatcaatagaagatggatgatgaaatgcaggaggagagattctgaaatagacagacagtgattaaggtaagaaaggaatgcgaagaaattaaacacacagcaacaactaaaatccacaatagcagcatttgccttgtaagaaataaaagcattgaagtagtagacaagctagactctaagtaatgaaaagtagacaaacatggaagacaaagtgccaatccaggaagcacaaatgcagaagagcaatgaaactgagcagaaggaataataatatacaaaaggccatcacctcccctggggaaaaggtggggagtgggttgaccaaggctaaaatgtgctcagtgaagtgaaaggagtcgttgaatttccagggaaaaaataaattagatacaacgtgatgaaaaatgaaatcgttccaaggggtgggagtgcttactccacaaagtaattcggggctctagaccttgggtgaggtagaagggaaagggggaggcagaggcaacctctagagcagaccaagggtataggagctcaggatgaattataaaaaatccctacaagcatttggcaaaaccgactcacacaggcaagtacatagtcatccctcattctataaaatattcatttacaaaaccaccacaactaatccaaccctcctaagactccttttcttttccataataccaaagtccaaagtcagtggtgctattggcctcaagaattgttgattcagccaggaaatatgattcacttacaaaggtaacatattatcctcagatatgcacaaaagccacataaaattggctctcatcggcttcctgaggaacttacaaaaacattgtagtaggttgaatggtggcccccaaaaatgtgaggttccaatgcgtggaacctgtaaatattgccttatttggataaagggtctctgcaggtgtgattaaattaaggattttgaaatgaaggggttatcctggattatctgggtgaaccctagatgccaccacatgcaactttgtaagaagaagacagagggagattttatacacgtagaggagaaggtgattcaaagacagaggtagaggttagagtgatatagccataagccaacgaatgccagcagcatcagaaattggaagaggcaggaacagagtctattctggagcttccagagggagcatggccctactgacacattgattgaagcgcagcaatactgatttcagacatctggcctccagaactatgaaagaataaatttctggttttgtttatgtttgtttgtttgtttgatttggagtctcgctctgttgcccaggctggagtgcagtggtgcgatttcagctcactgcaaactccacctcccgggttcaagtgattctccgacctcagcctcccaagtacctggggttaaaggcacctgccaccacacctggctaatttttgtacttttagtagagacagggtttcatcatgtttgccaggctggtctagaactcctgacctcaggtgatctacctgcctcggcctcccaaagtgctgggattacaggcatgagccatcatgcctggccaaatttctagtgttttaagccaccaagtttgttgtaatatgttacagcatccacaggaagctaatacagacatacaatttttagccaactgagatgtttagaaaaactacacggtactaagaattggtgactatgaaagattgtgtgtaacttgggcctctagtccctacttatattgtcaatggtttgatggttgggagagggcatagggaaaggtgaaacctttttaagatttactgtcttacataagaagaagtaaaatggtataatatattatttttcttaaatttgatgattagagaaaatacaagtttaggagtacttttgaaaatgcttaaagaaaaccacccatagaatttaaaataaaatgtgtactttgcaaatcactaaagaaaacttacaaactaaggaatattacccaaaaaagcaagaaaatataataaacaaaagcataaaacacagccaggcgtggtgtctcatgcctgtaatcccagcactttgggaggctgagggaggtgaatcacttgaggccaggagttcgagaccagcatggtcaacccagctaaaccccatcttactaaaaatagaaaaattagccaggcatggtggcatgcacctgtagtcccagctattcaggaggctgaggcatgagaatcacttgaacacaggaggcggagcttatagtgggcttagatcatgccactgtactccagcctgggtgccagagtgagattctgtctcaaaaaaaaaaaaaaaaaaaaaaaagcataaaacaggatgatggaaataagcttgtattattagtcaacagtaatggctaactgatataacagataacccccaaatctcagtggtttaacacaataaaggttaatttttcacacacttcacagtccagtgctagtctgcagtggggaacagggtcctgggtggggctggaggtgtctgttccacaaagtaattcaaggctccaggcctcatgtagggaaaagagaatggggggagaggaggcagcctctggagcagatcaaggttacaggagctcaggatgggcaggagactgagaggctgaccggatataaggcccagagcacagaagtgctaccgtctgaggcttctctgaaggatcagcaaagagctaaagtcaggtgcctgggcggagtgcaagactcagatgctgagcaaagggtctgcaaagggagcaaacacaggatcccagagagaggccccaagacgacggtgcacagggaaaggaagcctctaccgtgatgtgtagagtaactactgactgacctgtggcagggaaagcaggagccgtaaagagctatgagctggtgcccacatgggaaacattcatattgcaaggcaaagattcttgggttggataaaatttaaaagaatgctgctaaacagaagaacaacaaaatattaaaaataaaaggttgggacaaaagaatagcatgagaacacatggaagtaaaaagcagggatcacaatattgcttttctgttaaaaaaaaaaaaaaaaaaaaaaaaggcgaggccatcctggctaacacggtgaaaccccgtctctactaaaaataaaaataaaaaattagccaggcgtggtggcgggcacctgtagccccagctactcgggaggctgagacaggagaatggcttgaacccgggaggcagagcttgcagtgagctgagattgtgccactgcactccagcctgggtgacagagcaagactccatctcaaaaagaaaaaaaaaaaaagtaaaattcaaggttaaataacattaaaagagacacagggaatgctttcatatgataaaatgcatagtccacaataatgctaacagtcatgaatctgcactaagtaacctaatgagaaaacataaagcaaaatctgtcagaaatatgaggagaaattgacaatccttataggagactttagcacatctctcttagtcaagtaaaaaataaaataaattgaacaaaaatggaattattttaggtgattttaccatttgatgattatttaatactatgtgctagatgctttctatgtgatttcatttatgataatactcttagcaacgctgcttgatagattgaaattacagccattttacacgggggtaaattgaggctctgcaaggtcaccaagttagctctctcagaactagtatttgaggctgggcgcagtggctcacgcctgtaatcccaacactttgggagaccgaggtgggtggatcacgaggtcaggagattgagaccatcctggccaacatggtgaaaccccatctctactataaatacaaaaattagctggatgtggtggcatgagcctgtaatcccagctacttgaaaggctgaggcaggagaatcgcttgaacccagggggcggagattgcagtgagccaagatggcaccactgcactccaacctggtgacagagcaagactctatctcaaaaaaaaaaaaaaaaaaaaacaactgcaatttgaacccaggtctttggttccacagccagtgttttgactttatggaaacatttcttccaaggacaaagatacattggcccctcacagaatccctgacacctacagggcagactctggactctgtctagtgataggcagtctcagagcctccagtgacagggtgatgaggaagagagggcagctggccggaggtcacccagcacgttagagggaagcacaaggtcacagcttaagtccaagacagcagtcactaccctggaacattctgcaacgttttcagtgacctgaagcccagttttatttttccactttagaaaataaccaaagaatcttttatttcttttgcatgccagctggtccctgaagagaagagccttttattttgctatagacaccaatgctggatttgggctttggtctgtcttctcagtttttgctctttggatagcgtgatacttaattattattgtctgctattatgatcatggtttaattgttggtttgcagctcggtcagcttagaggggggcatttgataaaacaagtattattttcttattgccctttccgatgtcaccaaggataattgcagctgcattctcatgtggggacaggagtgatttctgacccccttccccctgcagcagctgttcattcacatgccattttcccctaatgtaaagatccaccatcatgactcacatcagcgatgggtttattgtgttcctgcagtggtgactgttggttgggaacatccaaagccctttcatattctggggcccagtcagaaggcaagtgaaatcaacaggtcaaggtgccatgaattttttttattttctcatttttgcatgtctttctttctttttttttttttttaatttataaagaaaagaggtttatttggctcatggttctacaagctgtacaagaagcatggtgccagcatctccttttggtgagggcctcagtaagcttctactcatggtggatagagaagggggagcgagcatgtcacatggcaagagaatgagcaagagaagtcggggaggagccacgctcttttttttttaattttattattattatactttaagttttagggtatatgtgcagaacgtgcaggtttgttacatatgtatacatgtgccatgttggtgtgctgcacgcattaactcatcatttagcattaggtatatctcctaatgctatccctcccccctccccccaccccacaatagtccccagtgtgtgatgttccccttcctgtgtccacgtgttctcattgttcaattcccacctgtgagtgagaacatgcggtgtttggttttttgtccttgtgatagtttgctgagaatgatggttcccagcttcatccatgtccctacaaaggacatgaactcaccattttttatggctgcatagtattccatggtgtatatgtgccacattttcttaatccagtctatcattgttggacatctgggttggttccaagtctttgctattgtgaatagtgccgccataaacatacatgtgcatgtgtctttatagctgcatgatttataatcctttgggcatatacccagtaatggaatggctgaatcaaatggtatttctagttctagatccctgaggaatcgccacactgacttccacaatggttgaactagtttacagtcccaccaacagtgtaaaagtgttcctatttctccacatcctctccagcacctgttgtttcctgacttaatgattgccattctaactggtgtgagatggtatctcattgtggttttgatttgcatttctctgatggccagtgatgatgagcattttttcatgtgttttttgactgcataaatgtcttcttttgagaagtatctgttcatatccgttgcccactttttgatggggttgtttgtttttttcttgtaaatttgtttgagttcactgtagattctggatgttagccctttgtcagatgagtaggttgccaaaattttctcccattctgtaggttgcctgttcactctgatgttcgtttcttttgctgtgcagaagctctttagtttaattagatcccatttgtcaattttggcttttgttcccattgcttttggtgttttagagatgaagtccttgcccatgcctatgtcctgcatggtattgcctaggttttcttctagggtttttatggttttaggtctaacatgtaagtctttaatccatcttgaattaatttttgtataaggtgtaaggaagtgatccagtttcagctttctacatatggctagccagttttcccagcaccatttattaaatagggaatcctttccccattgcttgtttttctcaggtttgtcaaagatcaggtggttgtaaatatgtggcattatttctgagggctctgttctgttctattggtctatatctctgttttggtaccagtaccatgctgttttggttactgtagccttgtagtatagtttgaagtcaggtagtgtgatgcctccagctttgttcttttggcttaggattgacttggtgatgcgggctcttttttgatgccatatgaactttaaagtagttttttccaattctgtgaagaaagtcattggtagcttaatggggatggcattgaatctataaattacgttgggcagtatggccattttcacaatattgattcttcctacccatgagcatggaatgttctttcttttctttgtatcctcttttatttccttgagcagtggtttgtagttctccttgaagaggtccttcacatcccttgtaagttggattcctagctattttactcactttgaagcaattgtgaatgggagttcactcatgatttggctctctgtttgtctgttattggtgtataggaatgcttgtgatttttgcacattgattttgtatcctgagactttgctgaagttgcttatcagcttaaggagattttgggctgagatgatggggttttctagatatacaatcatgtcatctgcaaacagggacaattttatttcctcttttcctaattgaataccctttatttccttctcctgcctgattgcccaggccagaacttccaacactatgttgaataggagtggtgagagagggcatccctgtcttgtgccagttttcaaagggaatgcttccagtttttatccattcagtatgacattggctttgggtttgtcataaatagctcttattattttgagatacgtcccatcaatacctaatttattgagagtttttagcatgaagagttgttgaattttgtcaaaggccttttctgcatctattgagataatcatctggtttttgtctttggttctgtttatatgctggattatgtttattgatttgcgtatgttgaaccagtcttgcatcccagggatgaagcccacttgatcatggtgcataagctttttgatgtgctgctggattcggtttgccagtattttattgtggatttttgcatcaatgttcatcaaggatattggtctaaaattctctttttttgttgtgtctctgccaggctttggtatcagaatgatgctggcctcataaaatgagttagggaggattccctctttttctgttgattggaatagtttcagaagtaatggtaccagcttctccttgtacctctggtagaattcggctgtgaatccatctggtcctggacttttttggttggtaagctattaattattgcctcaatttcagagcctgttattggtctattcagagattcaacttcttcctggtttagtcttgggagggtgtatgtttgtaggaatttatccattttttctagattttctagtttatttgcatagaggtgtttgtagtattctctgatggtagtttgtatttctgtgggatcggtggtgatatcccctttatcattttttattgcatctatttgattcttctctcttttcttctttattagtcttgctagcagtctatcaattttgttgatcttttcaaaaaactagctcctggattcattgattttttgaagggttttttgtgtctctatttccttcagttctgccctgatcttagttatttcttgccttctgctagcttttgaatgtgtttgctcttccttctctagttcttttaattgtgatgttaggatgtcaattttggatctttcctgctttctcttgtgggcatttagtgctataaatttccctctacacactgctttgaatgtgtcccagagattctggtatgttgtgtctttgttctcattggtttcaaagaacatctttttttctgccttcatttcgttatgtacccagtagtcattcaggagcagattgttcagtttccatgtagttgagcggttttgagtgagtttcttaaccctgagttctagtttgattgcactgtggtctgagagatagtttgttataatttctgttcttttacatttgctgaggagttctttacttccaactatgtgatccattttggaataggtgtggtgtggtgctgaaaagaatgtatattctgttgatttggggtggagagttctgaagatgtctattaggtctgcttggtgcagagctgagttcaattcctggatatccttgttaactttctgtcttgttgatctgtctaatgttgacagtggggtgttaaagtctcccattattattgtgtgagagtctaagtctctttgtaggtcactcaggacttgctttatgaatctgggtgctcctgtattgggtgcatatatatttaggatagttagctcctcttgttgaattgatccctttaccattatgtaatggccttctttgtctcttttgttctttgttggttcaaagtctgttttatcagagactaggattgcaacccctgcctttttttgttttccatttgcttggtagatcttccttcatccctttattttgagcttatgtgtgtctctgcacgtgagataggtttcctgaatacagcacactgataggtcttgactctatccaatttgccagtctgtgtcttttaattggagcatttagcccatatacatttaaggttaatattgttatgtgtgaatttgatcctgtcatgatgatgttagctggttattttgctcgttagttgatgcagtttcttcctagccttgatggtctttacaatttggcatgttttgcagcggctgttaccagttgttcctttccatgtttagtgcttccttcaggagctcttttagggcaggcctggtggtgacaaaatctctcagcatttgcttgtctgtaaaggatttcatttctccttcacttatgaagctagtttggctggatatgaaattctgggttgaaaattcttttctttaagaatgttgaatattggtccccactctcttctggcttgcagagtttctgccgagaggtcagctgttagtctgatgggcttccctttgtgggtaacccgacctttctctctggctgcccttaacattttttccttcatttcaactttggtgaatctgacaattatgtgtcttggagttgctcttctcgaggagtatctttgtggtgctctctgtatttcctgaatttgaatgttggcctgccttgctagattggggaagttctcctggatcatatcctgcagagtgttttccaacttggttccattctccccgtcactttcaggtacaccgatcagacgtagatttggtcttttcacatagtcccatatttcttggaagctttgttcatttctttttattcttttttctctaaacttctcttctcgcttcatttcattcatttcgtcttccatcgctgataccctttcttacagttgaacgcatcagctactgaggcttgtgcattcgtcacgtagttctcgtgccgtggttttcagcaccatcaggtcctttaaggacttctctgaattggttattctagttagccattcgtctaatttttttcaaggtttttaacttctttgccattggttcaaccttcctcctttagcttggagtagtttgatcttctgaagccttcttctctcaactcgtcaaagtcattctccgtccagctttgttccattgctggtgaggagctgcgttcctttggaggaggagaggcactctgatttttagagcttctggtttttctgctctgttttttccccatctttgtggttttatctacctttggtctttgatgatggtgacgtacagatggggttttggtgtggatgtcctttctgtttgttagttttccttctaacagtcaggaccctcagctgcaggtctgttggagtttgctggaggtccactccagaccctgtttgcctgggtatcagcagcggtggctgcagaacagcagatattggtgaactgcaaatgctgctgcctgatcgttcctctggaagttttatctcagaggagtacccagccgtgtgaggtgtcagtccgcccctactgggggttgcctcccagttaggctactcgggggtcagggacccacttgaggcggcagtctgcccattctcagatctcaagctgcgtgctgggagaaccactactctcttcatagctgtcagacagggacatttaagtctgcagaggttactgccgccttttgattgtctgtgccctgcccccaggggtggagcctatagaggcaggcagggctccttgagctgtggtgggctccatccagttcgagcttcccagctgctttgtttacctactcaagcctgggcaatggcaggcgcccctcccccagccttgctgccgccttgcagtttgatctcagactgctgtgctagcaaggctccgtgggcgtaggaccctccgagccaggtgcggaatataatctcctggtgtgccgtttgttaagcccattggaaaagcgcagtattagggtgggagtgacccgattttccaggtgccgtctgtcacccctttctttgactaggaaagggaatttcctgaccccttgtgcttcccaggtgaggcgatgcctcgccctgcttcggctcacacacggtgcactgcacccactgtccggcactccccagtgagatgaacccggtacctcagttggaaatgcagaaatcacccgtcttctgcatcactcatgctgggagctgtagactggggctgttcctatttggccatcttggctccacccccctttgcatgtctttccaatttgcaatgggatagagataaactgcctataagcagggaggtgggaatcatttgtttgtttgtttttgtttttgtttttaaaaaatacctagtgtgtccaagtttccttcagagtaaaagaactgaggaccgtgatctcagaagcaagttttgcctgtgggcagcacttgagagggacgggcccctgcagtgaaaatccactgtcctcccagcttcttagatttaggctctggtagaaaatctcctgttgctgaagctgagtgttgtgaaccttacactagcctcagcaaagcacagtggagtctcagagggggctggtgggaagaggtacgggagtgagggccaggtgggtccacccttagctagggcctgctattggttggtgggggcgtgggtgtggcagtgggaggtggaactctgaaaacactttgaggaaaggcatgtggagatctcagacttgaacagggttatctgcacatcccagggtgtccctgcagccagcaatgaagtcaagatccagcccccgcagagcaagcagaatttcagggcagccccaccaaggaatgggagggagaaccaggggcccagtgagacccagttacctgagctggcatacttgctggagttagactgcagattatcatgagtgcccaagatgcaacctaggcaaaccagataccagacttaggatgatgagaccaactcaaaagccctcctttggtggaacccctccctcactgccctcagccctgccccagcaccaaggaaactgctctcactaggagaatggggaccatgaattcctcactcctctgcagcttggacattatcaccattccctgagccacggcttcaggtctcagccacccgcatttcatgctttgtcttcctgaagagcttgtcatttcctgggtgggccagcctctacatcccctctgtgtctttgcataccctattttctctgcctgcattctgtccccttctcaccctcctcacccacccccttcatctggactcatcctgttaatctctcatctctcttttctcttataaagatatcaagactcagctcagtagttacctctcccaggaggcctggtctcatacccttggcctaagttagggggcttctccgtacatacctttactgtagactgtaccacatgcaggggtggaagcatgccatattcttatctgaatcaccagtgcctagtatgctatctgaacctagtacttactatttatagatttaaagtatgactatcagtatcactgtaggctcagggaacctacagggctggattttaaaagtgtgagaccatggttgcagtatcccagtttctcccagatttagattcagcagtgagctctggcccaggttctgtgtggctagattctatgtctttggtagtgtagagcaccaaagatacagctgtaagatccgaggggctagatgtggatggtaaaggaagagctcagaacttccagagaaataggaagtatcctccttagtatataggatttgtttaagttgcctcttgtagagtgacagatgcttggcaaggacagtgggtgagtttggatgaaccacaggggtccctgaaagctggtgagccattcgttcattcatcaattcagtcagacaacattcaccaaggggctagtacaggtcaggcctcatgctgggtaccagagatatagaagtgaatgagacactggcacaagagttaagggattcagcaagacagggaagtcaatggatgactctgatagagcaggagcctgtagagggagcatctcactagactgaggggatggggaggacaaggagaagcctgtggaaaagctccccactggatgtgaggcacctaccagtacacatcagtcagggggtagaagaatttactagggctgctgtaacaaactgaatagcttaaaataacagaaatgtgttttgttcacagttctagaggctagaagtccaaaatcatgttctcaatgggccaagatccctctggaaatactggggaagaatctgtctcatgtgtctcatagcttctggtggttgccaggaacccttcgcattccttgtgttgcagacacattacttctatctgtgcctccatcacatggtctccttccctgtgtctctcctgtgtctctgtatccaaatctccctctcttttctcttacgatatcagtcattggatttacggcccaccctaatccagtatgcccttcttgtcataacttgattacatctgattctatttccaaataaggtcacagtcacacaggtaccaggggtaaggacttgagcatatccttttgggggacacaagtcaacccgctacaagtggcatggggccatttgcagggggaacttccaggcagagagaaggctctgaagcaagagaataagaaggaaatcagtaaagggttagaagaatgggagaaggcaactggggaagcccaggggggacttggtgtgtcccctcggaagtctgactttatcctgtagagaaggaggagagactgggtcagaggagtggttcagaaagatagacgtggtcctgatggaaaaggtggattgaaaggatgggaggggaactggatccaggaaggccagttactctttcgattcctcttaatttgcttttccctcttttgccatctttctctccctcaatttctccacactttcctttcttcaaaactgtttcaaagacactgcctccttgaagctttccttgcctcttcaaattaaaagaaaaagaagatggtgtaaaagaaaggcctttggtaccagacagacatggtttgaataccgtctctgacccttgctagttgcctctgttaatcccttggaacttcagttcctccacagcaaaatagtgagaatacactctcaactgcagggctttatgaggatattcagcaatgtacataaagcagttggcacatgggagattttctacaaacgtttagctctttttgtcctccggttattttgatagcatcttatttattccactctttagcacctattgcacatattattatgttttgggtgtctccttcagtaagtttcctccagggcaagcacagagccttgcacatttctgcagctctcaacacagagcttgacatgcaacatgcttcatttctcttccctggaaatggcctgttttgtgtttgtggtccaaagaaacgcacacacagacaagcaagtcatcaataggaaggaagatcttttcacctctttcctccacttcagtttctcctacctaggggcacagtacaatggggaggggagctgcaaactgttctcaggatatcaaaagccagaagaagacccagtgttcacctacaggggagctgctcacacaaaccacaatggctgttttggcctggaattatctctgtcgatcagaactgctcattagcatttatagactctgatttctataagataagtattcaataagagtcttaataaatgtggttgggttggcaaaccaagtctttactggccatcatcaaaggtttataataaaaggggtcactggccccctgtggcagcccctagctaatttccctgcatccactcttgcccttgtcaatcttttcttacccaggcaccaagagtgatcgcaaaatgtaaatcggaacctgtcagagctcagcttaaaatataccaatgacttccctcagctcctatagtacacaccaaacatctccccccatccacggagtcccgccagccctgcccctgcctacctctcctggcccagtgtcgcctccatggcctttccattgtgacctttgcacatgctctcctttattcactgcaggcttcctcccacctctcacccctcctgctctccatgtggcttggcatcttgcttaaatgccacttccttagaaggtcttctccggccactctgtctaaagtggatgctctgcctcagcactctgccatgtcctgccctgtgctagacacagctgataattttttagtgagtttgtgtctggggggttattgcccatctccagaagctcccggagaatggcaccctgtctgtcatcttcactgttatacagcagcaccccgcatatgggaggcgcttaagtgaatgagtgccgaaaggggcttgaactttagcctctgtcctttccgttgccaacttgtattgttcgtgcacacagagaaccccgccttctcctcccttcttctgcactcctctccgcaacatcaatgccaagcctttgactttgtctgtttatcagatcagctaagccgaatgcaatcaactggcatttttaattcatatcagcttacgtatgactcacatataaactgttgatgattgatagagcctctccagcccctgcctagctctcaaccacagcctcttcctcccagagatgtgggcagcattgttaggagagagtagaagcactaaggtctgacctggattagtattaaataatagcaattccagcttactgtctaaccagcccatgaccttgtgcaagttacctaccctctcagagcctcagtattctcattgttaaagatgagactagtcctagctacaaaataaagatgcttgcatggactccatgggctaatgtgaaagtgccttatacacagtggttgttatggaaacacgttttccttcatgtctatttagtccccatattcttgcttttctcagcttcgtgtcagactggggtttcattcgttcattcattgattcactcactcattcattcagttgttcaccctcaggatttcacatggcctctagagtcagtctctaactagaatacaataaagcccaaactcccatagctaattttgagactcattctcttccctctctcaatcagctgtattctctatggcatcctaataccacctgaactcaagtatggagttgcctttcttcccggacagcttcacctcctctctgcctccaggtcttatctcatgttattaaatccaaagaaagcactctcctttcacgccacctaaacttcaggtctcatttccttttgccttccctgatgagtgtggcccacaccgatgtcttttctgagagcacgtacagccacaccacacggctggcactcggtctcctcttggctgctgatttcacagtgcattgatcaccacagagaaagcagagaaggcagggggcagcctggcacagcagtgagtatgtgtgtttgtgctctgtcctagggatctccttctcctcttttcaaatcaaatgtggggccccagccttacacaggtcctggttttaaggaatcccctcctatatctataaaagattctacctaggaaatccaagagattctgttggtttctaatagtactaactagtgaccgaaagtaagaaacacacacacacacacacacacacacatatatatatctgacaataaataactagaaaatgtaactaaacattaaatctcattcacaatagaaccaaaaccataaacttgtggactgccaaagaggaaatttaacaagaggtgtgcaaagaagaaaaccataacaaagatgaaaaacataaaactttgcaaagtacataaactaagttatctacaatgttcctggctggggaaaattagtaacataaagatatcaattatctccaaattaatcaatgtgtatataatcccaatcaaaatctcaatcacatttttttgggacttggtaaccataaagtttatctaaaagagtaaatttgggaaattagtaagttttagggaaaaaatcaaaatttgagaatatggaaacccaagtaaggtgagtagctacgttcctggtaccacaagtagattctagtatagggaaaggagagatcactggacttgagagaagagtccagaaacagcccgcaactaaggggatatttcaaatcagtagggagaatcaggattcttcagctatgagcgtgtcatcatccatgggtatcatgagcaccatccaaaatgtcagatacatcttaggcaaacaaggcctggttccacactcatgaaaattatgatctagttagggagaagcatagtctacaaataggtacactaaagatagactggtagatgctacggagggagtaaacagatgttttggtaggcaaagtgtggaagaggctactttagataggtgttgggagaattgagtgtcaatttggaagagtaatgaacttgttagcctcaaaaaatgaaactagccaggtgcagtggctcacacctgtaatcccaggaattttggaggctgaggcaggaggattgcttgaatcccagcattcaagaccagcctgagcaacacagaaaaaccccatccctacaaaaaataaaattagtcaaacatggtggcatgttaactgtggtcccagctactcaggaggttgtagtgagttacgattgcaccactgaactccaacctgggcaaccagataggccctgtcgcaaaaaaaaaaaaaaaaaaaaaaaaaagagagaagaaagaaactatacaagtcccaggaaagtattaaagttttgattaaagttttgttttgtttttgaatcgttgggtcggggagaggtctgcccaagcataacatgacatccagtatccttaaaggaaaatattaacgtatttggttacataaaattaatcacttcttaccaaaatggataccacaaaccaaagttaaatgagaaaaagtcaccagacactaggagaaaagattagcaacaaatatatcatataaaagagaaatcaaaaatataaggtaaataaaagtcataatatataagtagaatttcaaaagtttgcatccatcaattaagatggataaagaatttgaaagctacaaatgcccagtaaatatgtgcagagatacccaaccttactaaatcatctaaactcaaaactgccagagagattccactgtggtctagcagatgggggagtattttcgtaaagaatatatttacaacattataatatctaatgctgatgaggtgaactttagagagaatagtaacatcaatactgattagtgcgaatataaattgaaacaatcacttgagaggataatttagcaagatttattttaaaatttttatttattttattttctttttatttatttatttatttatttttgagacggagtctcgctgtgtcgcccaggctggagtgcagtggtgcaatcttggctcactgcaagctccacctcccgggttcattacattctcctgcctcagcctcccaagtagctgggactacaggcgcccgccacctcgcccggctaattttttgtatttttagtaaagacggggtttcactgtgttaggatgatcttgatctcctgacctcgtgatcctgacctcctgacctcagcctcccaaagtgctgggattacaggcatgagccaccgctcctggcctaaaatttttaaatagatgcccttcttcccctagaattactttggcaagtcaactgaaatattagcagaaatgcacaaagctacataaagatgcaaatgttccttgcaatttcatgtgaaattgtgttatataacaatgtccatttctgcagaaaaatgagggtgatgtttttgtccatgatatagtattaaatgaagaaagaaagttatagaaaactacataaaatatgtctcattttgagggaacaatatatttgcgtgctcattgaaaaaaactctggaagcatatgtaccaaacctactattaattgaatagctctggagaacaggttggctgtgtgaaagagagacttttttaaaattcagtacatctgtatattgtttgccttttctctgccttgagtatgtcttatttttaaaatttaaaaagatatttttaaaaagagatagtgataaatggattggatcctggaacacaaaaaaagacatcagtggagaaactggtgaaattcaaataaagtctggagtgtagttcatagtaagtatgccaacattgctttcttagtcgtgacaaatgcaccgtggaaatgtaagatgttagcaatagaagaaatggtgaaaggtctatgggaacaccgtattgtctttgcaacttttctgtaagtctaaaattattccacaataataaaaaaaattaattaacagagagagtcacacaggcttgtagccaaggtatctttggctgttggaatctttggttccagaaaaattcaggttactacttgagctcccttgctctgagagctctatctctgtcctgcagacccccacacagggagactcccacctggcctcctgaggtctgcagagattatctaagccaggcctacatatagctaatatccccagaattctgctctgggaaagcaaggtatgaggtcacccctacctgcaccatggctgggccagcttctcagagactccacagttccccctgccctctagccccaattatttttttttttttacctatatcctttgtccaagccagatcctgccttctcagtattccccttccaacctagaatggtaacaatatgggctcagggagaggtctgcgggctatgtaaggttgaggagagggatgcagtctgacaatggcaacatggagctcataataagaaaaggatgcacaaaacctacacctcgcacccttgtccccattgctggaggccccagtgggaggagctggcctggtgaaatgaggatgctgccagacgctgccttctctcccctcctgctgggcttcggaggtttagggctttgtaggtttagggccagtcttcgtaggtttaggaccttctgaccagaagcccctggaaagaagggctgagtccagatgaccactgcctcttctctccgtgcaggctacacttcctggtgtttgacacagaggaggttcacgacgtgctgcgcatctgggatgggcctgtggagagcggggttctgctgaaggagctgagtggcccggccctgcccaaggacctgcatagcaccttcaactcggtcgtcctgcagttcagcactgacttcttcaccagcaagcagggctttgccattcaattttcaggtctgtgcgtgccctctgccagccccactccacatgtcctgacacatggcacccaccttcctctggccctcactttccttcatccctcagtccatgtaaagatagttattgaacatctgctatgtgcctggtacatggttagcacctgttcaaatgtctgtgctgagctcactctggtagggaagacaggtgggttaatagacacatacaaataggtaagcatctggatggagacatacggtccataatggtcaccttggagcatcaaggaagatgttccagaaaagatgatgtccaagctcagacccaacggacaagtagaagttactcaagaaaagaaagtgtttcaaggagcaagtagtcatctatgacaaggaaaggtgccactgaaatggactttggaggacttgtgcacccctattagatggaaaagagagaaaagggcatcctaggtgcaaagaacacatgaacaagtgtagatgcaggaatgtgggctttggaagtggagggctaccccatgtggctgaagcacagggagcaaggagggatgtgggaggtacaagtagacggtggcttggggcatggttatgaataagctgatgggacatgctgcacgctcaggttcttagttgagtgcagatctcagcaaagactggaagtgaacatgagtcatctaaatttaattaattaggcactgcaatagccaattatggaggagcatgacaaagagctacccaaaatggccaatgctcaaacatccaaatcccagtatgagataatttatatgattggtcctgcctctccctggaatgcatcatctcatctcctctgaagtgcctcttccatcattcctccccctgatcaagtgactctgcttcggtttctgctcgtgtttattatacagcagctgtcttcattaccatctccttactccactgtgtgtgtggtgggagggagggggggagtttccatggtgattccagagcaatttcttgtggcacctgtgccgtggctttgcccccgagctctttcccagttggtgtatcagctaagggtggttggggtatatccctggcaccactgagattgttacagagttgcaaatcctgcttctagctcttttctgctacgtctgtcatctctgtggaaataagcatttagcagcgtggggagcagatgagagtctccaggatcacattgctttatacttataaatttgtccatttaacactcatgcatgcttctagtctagcattttccatctattcctaagagttccatggaatactaattgatattgcaagaaaaaagaagtttgcatgatcaagtgatgctggggaggtgctcaggctgatgcagacccaaggaaatgatctgcaatatggggcctctgagaacgtttgctatgctaatgcccttaaattcaaaagatgtctggtaggccacaatttccaaacatattccatcatggatgacttttttcaaggccatctcaagagactaacatttcgtggaacaaacttgggaagttgctggaataagcaatggaaggatctcccagcagtaaggagggtagaatgctaaagagacggctcgatccactctctggggaaagaagtattatgaataattaaagccagacatattttctccaactgcgcccaagctgatgggtgcggcttaaaagaaaagaaaaagcccataattatgctgacaaattcacccacagatttgcattatctgacctcgactgcatactcagtgtagccacgcgggacagagtccctgggtgctctcctatgctgtatgcaggctgctttctcatgcattgcccagctcatggaagtcctattcatccttcaaggttcatctcagatgccactgcctcctaatctccccattcagagtaaaactgctatagcccacggcaccctggcactttacttctatttattcaataccaggcattctgtctcgtcttgaagctgggcacctacttgacatcccactaaaagctcttagaagacagggtcatgccatgcctcccgactctctcatagtgtatgtatgcagcaggtgctcactcacagcttagtgagcaaatgggcacatgaagatatgaacacatgaatggatggttttctctaacagaagggtttccttgggcaagctgcccttagcattgcttaggcagagtagcatggtcaaagctacctagcctgggctccagaaaggtcatgacagcctggcccagtgttatgggcataaccaaggtttgggaaaggtcaccttccctgttgctgtcatcagttagcaaataccaggactactctagggaagagagaacggctcaccccatgttaactttatagtgtgtatttgacaggggattgtacagaaatgccagggacgattagtgcaggcttggctttattaagtaaacatgactgtgtaacatctaacatcctgtctgtaccacgtggatccagcctttccccgggtgctttgccaagcagctccaattcaggagcattaaagagagaaagtgagaacaaaaaaaaaggtgagcgggaagcataatcacagccattcctattgagtggctgccacactaagctctccactacatcagctcttacaattttcacaaaacccttacagtatgggcaccattattactccatgttgcagatgtgggctccgaggcttctcatacaaggtcatctagttaatagcaaaaaccatgtgtctgtttcttaaacctaagctgctaatcattgtactctattgcctcccatataaataatccttccaagtatggccagaacaatgagctatttttcttctaggggaacatttacatgtgtacagtgccctataaagctagagatgaaagctaagtctgattttaactgggaaggaaaaagattgatgcatatttgactttacaaataagttcagtagctgtcaaatgttgatatgtaaacaaatgagtgtgcctgtgttccagtaaaactttatttacaaaaataggcataggcccagatatggccgtgggccatagtttgctgtatgcttccttaggtgttattgagtagaaggtatcagattgtgtaactcaagactcgtatacaatcccagaggttataattagtgacatcagtgtatacagttgccctaggctgccgcttctcaaacttttccgctgatgtcctcctgatagcagaagagaatgggtgtgcatcctcaggatgtctggtggctgtagcaagcacaaaatatctttaaggcttcacatttttgcttaaaaactaatatgaattttaccttgtaatccagaataaattcttttgttttagtataaaagtagtttttccttaaattgttgagaaaactgatattccaatcaaatcagtattatttatcctgtggtttcaagaacctccttgccctagagtgccctgagcacaggctatgagggatgacatagctggggactgggaccgggccccgctgtcagctctgggctgtggaggcagccagggttgttccagctcttgagattcctttctctggactaactcttgcacccattcctccggtgtgttttctcatgccacatttgttcatttattcacccactcattctcctatttatgtattccttccatctagcattcattcagtattcgcttataaaacacctgctctatgttaaactaggttaggtaatagacacgaagacgtcgcaaattcctgagtattttgaatttttaatatatctcagctatttttgaattcttctctgcccacttgctacaaatatctgacttttcttcaaatatggtttcagtctaatggatccttggttgtctgccattgcaagagagagcatgatcttgacctaacttcagtaactcccggtaacctcacaaccactgcttagcatttaggcaggccaactcgcaaagtcctttgcaaacccttccaattgaatacatggagtttatttgtttgtttgttttagagatgagctcttactctgtcacccacactcgagtgcagtgacatgatcatggctcactgcagccttaacctcctgggcttaaaggatcctcccacctcagcctccagagtagctagaataacaggcaactatcaccacacccagctaatcttttttatttttttgtagggtcagggtcttgctgtgttgctcaggctggtctcgagctcctgacctcaagtgaccttcctgccttgacctcccaaagtgctggaattataggcgtgagccaccatacctggcagcatggagtttagacttaattatcttgtcacttcctccttctgatcatgttagttacattatacaaaattgcaatgctttgtttatgtaacaatgcttgtattcttaagctgaattcaattctataattataacagtataatcatgcttaactcatagcatctcatgacaggcagatgacagtaatggtgaaggtactggaagaatggtagtggtgatatcagtgagagtgacaagtgtgatcacaattggtggtggaggcagtgatagtaatgggagtgagaatagtggcactgtggctacagctgatgatgatgatggggaggttctggtggttgtggcaatgcacggatgatggcaatcagtgagggtgatgagctgggagcctcctgagtggcagacacccaggcgaccttaccctctcttctatttccttgccccagtgtccacagcaacgtcctgcaatgaccctgggatcccgcagaatgggagtcggagtggtgacagttgggaagccggcgactccacagtgttccagtgtgaccctggctacgcgctgcagggaagtgcagagatcagctgtgtgaagatcgagaacaggttcttctggcagcccagcccgccaacatgcatcggtacaaagcagctgcagggtgcactctgctcttggggctcacagttgtgtgctccagaaccttccatgcacagcagctgcatcttgggcctggggccaagagaattgaaacagacaaaagttgcagaaaacccattgtttaccctgctttgcatgcatgtgtccccacacgcactcactcacgttcacactctatacacagagcactacaaattcctcacttgctaaaattgtcccagagatttccaagtcagacaggtctgtccctttctctctggcccaggctgtacaggtcagaaggaggacagtgggtcatcttgggtaataaaggctaacagattccgaaatgacccttctattacctgaagcaatagaagggcacccacagcctcagaatgtaaagaaaagaaccttgcttttgctgttctcaaggaaattattggttacctgggttttggttcttttaggttttagagatagagtctcactctgtcgcccagactggagtgcagtggcaccatcacaactcactgcagccttgacctcctgagctcaagtgatactcctacctcagcctcccaagtagctgggcttgcaggcctgtgccaccacacccagcaaatttttgtatttttgttgttgttgttgagatggagtctcactatgttgctcaggctggtctggaactcctgggctcaagtgatcctcctgccttaacctcccaaaatgctgggattacaggttttgtttctttagatctgtcctcagtcttaaaaccttcctgtatgagagatgaagacatgaaggacctgagacttgtctaaggtcccatcacttaaaaagggtggggcctgaaaaatcctgcctctaactacttgagactgagaggaggagggaacttgaagggaggctgggatgggaaagaaaggtaaatagatagagacaaaccctccaggtgcccacttccacatgtctattttgctcaggtgaaataatgagtgtttatctcccctgtcaatgctggctgttagaagagaagagaacccatggtcactgagtccttactgtgtacttgccccatactggacatttacttagataacctcatttaactttcccaacagctctctgaaattagcaccatttcctcatttacacttgaaactgaaacttagacaaatttggatatcttgtcccaaatcacagagctaggatatggcagagccaagatttacacccacgccagtctgaatgcaaagcctctcattttcctacctcccacactgcctcccctgctggagatgggtgtaaggggcttcctgagacagctcctgcaggagcgtctgccctggcctgcacctctctcactcaggcttaatgggaggcagtacgctgcccaggcctctgaggactggcctatgacagtcatggctctgaggcctggccctgaagttgacacactaaatcctgctcctcagtgggaattaggagccgcataggtatgtggggcaggaggttgagacctgggtttcagatccagctgagttcttcactacgtattctgctgtgtagggaacagtatgggatactgaagtagacacatccagatttactttctagctctgccatttactactttggtgaccttgggaaattacttcaactctctgagcctgagtttccttatctctgagggtaaatacacttcccttatggcattgtggggtgaggacacgcctaaccccaatctcaagaaatactaatttccttcctttctatcttccttccttccttcttttcatccttcccttcttcgattccttctttcaagtcttcagactcccttccccttccctaagccagaattccatctgctcaagggaattctgttgaggcccaggagagaatctgggaacctctgaggctccttccaaattcagccttctgcaaggctgtgattccttagacttattttacagaaaagcaggtcctgagatgagattgtcccaagtggagaaggaggattgtgctaagctgaggagagcaataaatgtgcagtgggtagggtggagaggttaattcagttttcatcacccgttcttctacactcggctttgggaaatgttcctcaggcaacagaataaatgcctttgcctcttctctcaaatgaactggaaatcccagtgacatgcttctgatttccagctccctgggcgttctgccatgagcgggtctagctggccctgataacccttcattacagggaggaagcaaaggaagaaaacaaatactcattggatgctgtccccgtgataggcaccgggctaaacattttagctacattattgcagctgaaatcactctgtggtgaggttagagctcgggattccactccctggctcaggtctgccttcaccacagcaagctgtgtggccttagacaaattgcccaacttccctgtgccttaatttcctcaccagtaaaatagtgaaaatggtagtacttaccatctagcattgttttgaggattaaaaaagaaaatactataaagcaataagaactgtgcctggctcatagttagcactgtgtatgttagaagccattatcatcattattcttttactttcgagatgaggaaatagaggctcagaggggtggacagctggcccaaactcacacagccaatgagtggcattgtcagaatttgtgctcaggattgtatgacttccaaatcaatgccctttccacaactctcaccctcagtccaacctgcccacttcttggctgtctagaaggatctgcagcttgcacccactcccatctgggcaaccatggtttagtaagctcaaaaggacccctcgactaaccctgagcagtaggagccttcctgttggcgaggcagcccagggatccaagcaaggccttggggcacaactggcagcagccagggaagcccatgcccgatgccatggaactatctagaagagatctgtgcccagacagcagcctagaacccagagacactgatagtactttgggggttggtgggagagtaacaggggcagtttcagaaacacagagactcaccccatctgtggcaaacttaagggaagaagcccctgagctggcaaagggacgtggaggctgggaaccagaatggaggcctcgttgtgcccccttgggaagatttccccagagttgggacttctgatatgacactggctttccactctcactggccacatcagactctgtttctaggctggcctgggcaaggccacgctccatggactggacattacagtcttgctttgttaagctcaagggtctagactgattgtactggcctctgcttggccccacttatctagccctctgctcctgaaggattcagtggtggagacacaagtgagacataagcagacccaacttaaggcaccacctcgctcagaagctcctgcaacaactgtgctctccctgctggccagcggggagaagcacgcctcctctactctggctactgctaccgactgtatggaagtagaaagggggaaaacaacagactttggagccagtcccatgtgagtttgagtctcagagtgactctgggcaagttacttaggctttctgagactcactttcctcctttataaatcaggaagaataatccattgctcattgagttgttaatgagacataaatgagatagtgtatctaaaatgtgatttgttaagtctaatacgtaatagatgcctatttgagtgtttctgatactcaggatggttcttgggatatattttcccatggaacaaaaagcagactactcatgaccactcggattttatgttcagccacattagggctcttatggcctgacctgaagacctaccatttgtttgagaccctgttagggattgacccagccctttaagcctcaccctgagtaaaagccacagccagaggtggctccatgacacagctaaagtaccagtgctcagctctatgacaagccaaaggctgctcctaactttggagtcaggtatacccttttgctccccccacaaagactcatcttggattttctagccagcccttaaatggctctctgtgttcctgtgggctcagtgttgacaacctctgatggtgccctgtggtttccagaccaaaccatacctatagtcttggccatcctgctaacgaccccacacgcttcccagctcttactctatccagtcctcatgccacggtacagcagccccagccatggaggaagagacctgatccaggctctggggaagctgccccagaaggtccctaggtaaataggttgctgtgtcacctggccactttctccctccccacctgcttgagagacctgtcatctcaggggagggcgaccacgtagactgattggggattaataatagctccatacaactgaggtacacacatactcttggacaaggccttttggaaagttggaaagtatctgcagccgcgagcagatgccaggagcactggcagcgtaggagaccagctgcgcttggcaggcgaatgtgagcctgtttcccactcctcctgacattgagtgcacgggaactcacagtcagtacccacaaagcttgccgggaagccgatgtgaggcagtgaaggaaggccatgtacttcataggtgtacagacagtgccggctccgtctatcaaccattcactctctaccaaatacttcagcagacatctccaataatctttacaaccaccccacagagaagatattgtctctttttatgatacgggagagacatcgagggctagagaggctagatgagttccctgagttcacacagctaggaagtagcagggtcaggtatttttaaagaataatttattaggccgggcgcggtggctcacgcctgaaatcctgtgactttggaaggctgagatgggtggatcacaaggtcaggagatcaagaccatcctggctaatacagtgaaaccctgtatctactaaaaatacaaaaaaaaattaggtgggcatggtggcgggcgcctgtagtcccagctgcttgggaggctgaggcaggagaatggtgtgaacctgggaggcggagcttgcagtgagccgagatcgcgctactgcaatccagcctggggctgggggacagagcgagactccgtctcaaaaaataataataataatttattgaggtgaaatgcacctaacataaaattacctgtttttcaatgaacagttcagtggcatctggtactttcgaaatgttgcgcaaccaccaccactatctctgaaatattcccaccctccaaagtagaagtccatcatttcaccttctcctgagtccctaagccaggttcaacttcagcctgtcagcctcagcctctcctctctcaatagtgcattagcaacacccatgaaaatgagcccagggtgaagaggcagcctcaccctcgtcttcttctctcctcagctccctgcgggggagacctgacaggaccatctggagtcatcctctcaccaaattacccagaaccctacccgccaggcaaggagtgtgactggaaagtgaccgtctcaccagactacgtcatcgccctggtatttaacatgtatgtacctttcccccgggtgggagacgaagggttcagagtggctaggggctctgggacctgggtctccaggtgagtattcacaggtctgtagcagagttctcagctccagggaggtgaagaagccgagagagagagaaactagcatttattgaacatctacgtgccaagcactgtgctcagtggtctcatgcatatcatcacatctaatccttgtagtaatttgtgaggaagcaattattatttcctctctacctctgaagatactgggacctggaaaggaggcctttgttggatgcccttgccctgccctctgcattcccagtctgcttccccggccccttccaccccactccagaggtataaacaggcgggcttgggtcccaggcaccccccccaatctagctcctgcacttgcttttccattcctgctacagaaaagctcttcaaaagaactgcctctgcctttctctacttcctcacctcccgttcactctcaaccccctggaacctggtttctgcctccatggttctactggaaactcctctgataaaagccacccacgaactcctggttccaaacaaaatgggcctttctgtgttttatccactccacctcttgatcaccctttccatccttagactgctttttcccttggtttgtgtgaagttactcttcccagttctccaagctcttctgtgacttcacgtggacctcttgttaaaccatcttcttttgccgggctttgtcaaaacctcctcttcttcccctacacccctttcctggacaagttcggtcattcctgtctccactctcctcttataagtggaagactccattctgctgcccaccctggctttattctgagcgtcagcatcgctatccagatgttgggcatctctgtctggggcctgcagacactgcaaatgagcatgtacaaaatcaagcatattttttctcccccagaagagctctgttctgagccttggggctggcattgacacctgctctcacggcttcttccactagcagcaaccaaggcatgcagcctctatcgccttcactctcctcatgtatttcctcttctccatcctcctagctcctgtcctggtttaagtcctatcatttcccatctaaattactgccctcatctcctagctggttcctctgccccatcttgcctcccatgccgatctctcccttagctagctgtcagagtgatcgtgtcactcaaaaatgctgaaataaccaccctactttccattttaacatcctctaatgacagtgctcagcaataaaaaagaatgaactactgatacatgcaacaacgtggatgagtcccaaaaatattatgctgagtgaaagaagacagacataaaaaagtacataatgtatgattcaactcctataaaattgtaggatcagcaaaactaatccctggtgaagaattctaatcagtgttggcatctgagggtagggaaggttgaatgggaaggggcatttggaactctctggggtggtgggacagttctgggtcttgatatgcatgtgtcaaaactgatagagtggcacaccttagggctgatcatttcacacggtgtaaatcatacctcaattcaaaaacaaagaaacaaacaaatagatcctttatttttaaatcctatcatggccctctattgcttataataaaggcccaaactttggagtttcattccaaacaatctggtgcttgcctacctctccagtcagccccccaccccatcctaagcccaccccatcctaagccctaagctccagccagatggaactccttgcagtttcagggcctcacggattctttcatgcccttatgactttgcctctgtttctgccttcacagcaacttcctgttccctccttgtcctatctgtaagggtcttctcatctcccaagactcagttcaggcttgatttcctccataaatgtttgatttttcatcctccccaaggaaccttgctttgtgtttctgctctgcctcgggctgacttcatacattattttgttgttgatatatctgtcacttcctacagcaccatcaatttttgaaggcagaagtggtgtcttacatgtccccatgtccttggcaccttgcacagtgcctggaatatcgagggtgctcaaaatttgatgatggaagggagagacagaaagaaggcagttagttaggaagtggtgatgccatcatttgtgaccaagactcactccctccgaaacccttcgccggtgactttcaaaagagcagatgtcaagaagctgaattacaggggcaagaagaccgtgtcacccagccatggtgtgttgaccccgcaactgacaccagtgtgacaaggtgccaggtgggaaggaggccagtgcgcatctggctctgtgccccgtgcctcccagtcccccatcctgtctcttagccagccttatctcctttgtcctagagatgtatgacctcctccccctgctatatatcttagccaaaaggtagaacagtcattttactctcaatctcaaatagagtacagtaagtcctcagtatcatcaacaggttcttggaaactgttgactttaagtaaaacaaagtatagcaggtcttcaaatgtttccttcaatgtcatttcattatattgtttttgttttgttttgtttctgagacaaagtttcattctgtcacccaggctggagtacagtggcacaatcttggctcactgcaacccttccttcctgagtttaagcaattctcatgcctcagcctcccgagtagctgggattacaggtgcatgccaccacacccagctaatttttgtatttttagtagagacagggtttcgccattttggccaggctggtctcaaactcctggcctcaagtgacctgcccaccttggcctcccaaagtgctgagattacagacatgagccactgtgcccagcctgtatgttgatgagaaataaacaattggttttgttatatgtcatttcacttaaagtcatggtttctgagagcctgtggacaatgctgaggacttgctgtatctgagtatcccagaccatggctgggcaggagcaaatttgcatctgaaatctattctctgcaagctcatttacttttctattgttttcatctttgcacacttgattggtatcaattgcctttgttagatatatacttaagagtggaattgctgcaccagagcacaggcatacaggggggacttcaaaaagtttgtggaaaaattgaatttaagatgaaaataaaaaatataaactttattactcaacataaactccatcaagttcaagacacttttgtaaccaactattccagtcattttgtccatccctaaagaacagagggtcctggtaatttaaccatgtcaatgtagtcttttttactttattaacggaagaaaaaatgggtgctctttaaagatttttttaagattagaaaacaaaaagcaataagaaggagccaaatcaggactgtaaagtggatgcctaatgatttcccattgaaactcttgaaaaattacccttgttggatgagagaaatgatcaggagcattgttgtcgggcagaaggagtctctctcgaagctttccaggcactttactgctaaagctttagctaactttctcaaaacaaactcctaagaagcagatgttatcattctttggcccttcagaaaatcaaccacaaaatgtctggagcatccataaaaaagaaaaaaacccattaccttgacctttgctccacttttgctttgactgtacacttccattccctggtagccattgctttgattgtgctttgtcttccggattgtactggtaaatccatgttccatctcctgttcttgggagaaatgtttcaggatcttgatcccacattttttaaatttccactgaaagctctgcttttttttttttttttttgagacagagtctcgctctgtcacccagactggagtacagtggcacaatctctgctgactgcaaactccacctcccgggttcatgccattctcctgcctcagcttcctgagtagttgggactacaggtgcccaccaccacgcctggctaattttttgtatttttagtagagacggggtttcaccgtgttagtcaggatggtctcgatctccggaccttgtgatccgcccacctcagcctcccaaagtgctgggattacaggcatgagccaccatgcccggccaaaagccctgcttttgtctgcagctgatctaggcacaatggttttgacacccatcaagtagaaagtttgatcaaccttaattttttagtcaaaattgtgtaatctgaaccagtcgagatgtctatggtgttggctttcgttagtgctattaatcattggtcctattcaattaggacacaaacaagattaatttttttcctctccaactgatgtggaggtccgccttggcaggcttcatcttcattatcatcccctcccttcgtgaaacaagttatccatttgtaaactgctgatttctttgggtcattgtccccataaactttttgtaaagcatcagtgatgtcaccattcttctacccaagcttcaccataaatttaatgtttttccttgcttcaattttagcagaattcatgttgctctgatagaggcttttttcaagctgatatcttgtccttcttaatgcctcacattagatcctgtgcagacatgttataacaagttagtgtgagtttattttggtgcaaaaaacttttgaactccatgcataattttttcgtaatatgcattttccatcattttcactcgagccattccagtgggataaattacattcatgaactctaatattcaatttgctcaactaagtttttaaaatggatttttctctcataccagggtcagaatagctaagggttaggacatttgtgggtgctaggcgtggggcaatagcagaccctgaggagagctggagcactggcttgggatgaaggcacaaagctagggtccttcatggtaacaggtcccttcctccctgagaatggcaccatagttggctcattctctcttagaaaatgaggttcagaagagcacagtataaggacattagtgtcaggtaagagagttgggttttggacctactttggttgacagcttggtgtccagagttggcaactcattttcccttctgtataaggaggacgttaggttttcagctccagatttttagacactgactggaatctgactcctctgcccctgagcctgcctcttccatcttctcacctgactgaggtcatcagggcctcatcttctcccttcccaccagccagtcttcaggggttgggtaccagtgggatggtgggcttgctccctgggaggccctatgctttggttgagcctaagaccccggcaaaagcctttatttgaccttagtggggtgggggtgggatgtttttgttccccagctttaacctggagcctggctatgacttcctccatatctacgacggacgggactctctcagccctctcataggaagcttctatggctcccagctcccaggccgcattgaaagcagcagcaacagcctcttcctcgccttccgcagcgatgcatctgtgagcaatgctggcttcgtcattgactatacaggtaagggccctggtgccagagagtactgaggacaggtccagctaacaaggcagagggcaagtagtgtagcgtagtgaggagagccctgggctggaccacagcaagcccacaccaaccctagcactgctgccgcctgcagaaacctgcctttcctgcggcccccatctgggcttagtctttcacccctatattctccaggggtgggaaaaaagggaaccagcattctttttgcacctcatctatttccaaccactagtcctcttctctttttctatgagggtcattcctaactctatttcaacctcatagctatcagctggtatcttccttcactccacttcactaaagaggattctgatatgaggcacaatcttcctctccactcagagcttctcaccatcctgggtaacttcaacatccctatggacagcccatctaatcctagggtcatggtgcttagacctctgtcccaaggacactccttggccacactctgacacctcgtcatagactggtcactttctgatacctcctgatcacatttgctcatccttccagctgtgctaattaaggcaagttcagtagtgttgtggtagagagcaagagtcaacaatttttcccctaaaaatagtaaatattgtaggtttacctatcacaactactcagccctactactgtagtgctaaagcagccacagacaaaacagaaagaaatgggcgtggctgcatttgaagaaaaattcacttacaaaaacaggctgtccctgcccagttaagagcattgactgtcaaattaattggattgaaagttcatgtttatgacttaacatttgcgtgaccttggataaagcattgaacctcttgaagcctccatttcttcctttataaaacgatggtaggaaaattcctgcttcatagaaatgtaaagatcagtgagtccacacatgaaagtccttggtacagtgcctggcacatatcatgcattctgtaatgttcaagtatcattagtagtagtaagaggagttccaggctctcgagcactccactgtcttctacgctattatctctttttgaccttttagtcttccctaattatcccaaatcccattatctaaatcccagctcccttccttgcttgatttgtgagcttgacaagtattatctcttggaacatcatctacaaattgttgctagtaataattatgttgcaggaggttaagattaaaagatattttatacatgcatattttatatatgtgtgtgtgtgtgtgtgtgtgtgtgtgtgtgtgtgtgtgtgtgtgtgtataatgctccatatgtactaaacactctacagatgctctgggaatgatagattttgttattgttactataacccgggttcacccaggcctcatcagcctgagcatacaaatggggtcgcattaccagctaaaattaaaaattttctggctcatgttccccacttgcataacataagacctcagataccttttaaagtgtcccctaattaaatatttccggccacccctgggaatatctcacatgagctcacacataacactaattagaacaatggcaaacttagtgttttcccactgccagcaccagcctaagtgctctatatccatcaactcattggactcctcatagttcttgattatctcctgtttgtcgggtacagttctagaagactggtgtgcaaaatggagaatgttttacttgtagtcttcttgcctcacggggctggcctaggcaatggatattctgccatcctttcttcctccaggcacctgccatttggtaaacctcctgggcccaaaccctcttccacacactgatatcagcacagtcagacactttggaattctaacaaacagaagccacaacttagacccagtctgggacctccattgctcccaccaccaccatccccactgccatatcatcaccatttcttattattcatctcttccttcatattctcatcagtaccctcaattgtcctgcccgctagtcctccaagtgcataaaccttgcaaaactgtaccctttgttgaacccacacccacacagctgaggacacccagacaaagctgcacaaacgtgatacttagagtcactacgagtgatgtcctttcccccagccaagccttagcaaccaccagagctgcctccgacttgacccaactgagttcttcttggcagagattccaaaattcaccccaaatgtcaccccgtcagcctcattttttataagatgatttcatttcagcttccctggatacagtaagctattgggtagaaaccccctgagcttcctctccagtcaccttgttcatgcctacctgcctgtggccatctctcccccaggtcttctccaaggaaattcatggtccgagagccatactttcaaaacctctttcccagtgaagttctttccacttttgcctgttgacccaaggtgggtatctagaggggtctttaggtctaaaccataacccggggaataagacctccccagctgccatcggagccagccaagcagccaattactggagagaggggagaagagaggcacatcctacagacgtatcccccatcaccctattaggatctgtagtgcaagtaccaagataaagataactatgtgtgtttgaggggtagggggtgcctgttggaagcctcaagcatccttcattatttcatttgttccttccttccttccttccttccttccttccttccttccttccttcattcccagactacacacctcctaatattagtcaccctctactatctccctgggcctctggtctagtagcccatttggtggaacctagggacccctaccttaccctctggtctgcttctgcctatgccaggatccctggattcctggaatgggtctactttgctatcaggtcccatggctttgaggatattttcccatgtacactatctttctttatagggtaggctccatcacttcataactgtatgccctgaaacaagttgcctaactcctctgagcattgcttcctcatccatgaaaaagggacagtgacactaaacgaaggagttgttgtgaggattagcacataggcacagcatcaagcagagtgcccagtgccaataagtatttgatatgtactttgatccacccactttcatcccacctcctttttcctacgtcactggtattgcatttgttgtgcctttgtttggaagggagaatggggctaacccaggggaacacggtacatgttcttttctgtttactgaagatgtaaagtgtgagcataatgttttgcacatgtaataagtgtgggatatttataacatgaatatttgtgatagacgtatgtgtcccatatgctttgccagcccatagcaaagaatttagacattccacaccctgtaagtctggagagaaccatagatggagaggcagcccactgaggacctccacagggaggcagggctgggtcctcaggaaaagcagaattggcctctgcatccaggaagcatctgtgtccatgtcttttagagagatccagggctctgctaaaactgagagtctgggtatcctgggagctgtggcttcaggggtcttgcttagggaggtgaaaggggcctacgagcgccccacatagagagatgttgctggactcagttgggctcagcacaggggaaattactctctgagattaacccttcccctgacccaaggcagagagaccaggagcctttctccacacacagcttcccaagtgagaagcagaaacagtttggtagaatcttaggaaatatcaaaaaaccactcagagcaacttaagcaaacaaaggggtaacttattataaaaacacaagaaacagaaacccactcaaaacaatctgacacaaaaaggagacatgattatgagaaaacaactaacagcctaagtaacttaagctaaaaggtttctatattttaacaatacagataacaataactctgacacaaaaaagcaaaatacttttagaatacaagagcccaagggcagaaagcataaactcccaaaggactggaatcaggatggcagaggcacagactgagaccatcatccgcactccagaatcgttctctctcctccctgcctccttctgagcacttgctacattctcccctccctgcagatcaattttccttgcttttccattctcctgggataaatgtggctgtctcactcctgactttttttgtttgtttgtttgtttgttgttgttgttttctttcctttttttttttttttttttgagacagagtgtcactctgtcacccaggctggagtgcagtggcgcaatctcagctcactgcaacctccacctcccaggttcaagtgattcgcttgccttagcctcctgagtagctgggattacaggcatgcatcaccacacccggctagtttttgtatttttagtagagatggggtttcgccatgttggccaagctggttttgaactcctgacctccagtgatccacccaccttggcctcccaaagtgtgatacagggtgtgagccaccgtgcccagatcactcttggctttgaatcacttcccagtttagattccagtttcagatcccaaaggatcatctgagggaacaggcttaattcaagtgtccactgagcagcatcatgggattaggcttttgcagaaggggcaagagcaggtcaggcatttttatttatttattcattcggtaaatacgaattgagcagctaccatatgccagaccttcttacaggggctgagaacagaccagaaaaccaaacaaagtctctgcctccatggagttcacatcctcgtgacaactagaccgacggacccttctgtagatgagatgttggaagcccacctggttctaaggcaaagaggggtgggtttttagatgtctctgttcagttgcttctgaagggtgactgtagtgtcttagtcatctctgggcagactttctaggagatgattctgaatgcagtcatgtcatctgtggatttctattagaccattgatcagaggcacttctattctgaattcatcctcctgggtggctttaccctttgctaaaaggaaacaaagaacagcagggatcctgtgttttggatacagttaccaaaatggagtcacagggaggtttatgtctttctccaggccacggatatcaacagaaccagtggggtggaaggacctttattctcatataccagcatgtgtggcagccttttcctaggcaggaatgtgctgaaacatccacgcacatgcaagacatattcattcattcaacaaatgcttgatgactcctacttcatgccatgccctctgctgggtgttgagaatacagcagggagcaaagtaatcatcatccctaccctaatgtaacttacaggtgagtgagggaaacagcaagaagtaagaagcataagaagttaggaaagaaaacaacaggctcctctgagaaacaaatcagaagggttgctgtgaaggcctctctgagcaggatccatttagacagagccctaaaggttaagtagaagccctctgtgccagagtgggggccaggggcgtttcagagggaagagtttgaagtgtgtgttagagaatctgaaagaacacaggaaagaccaaagtgaatcgatttttaatggaaggtcctaaaaagcatgtattttctctttcaagcccttggaagtaacactgtgggcctggaagctacggccacacctgctaccacccctattcccaccacctgctgctgttatgggtcattcttcttaaatgcaaattagaactatcttatattctgcctccttttaaaggaatgcatgtttgttggaaaaattcaaacaatatataagcatataagatatactcttaaagacttagcatgcccccaaataccatcatcccgtgcaataccattattaacagcttggtatctcatttcggatactttctataaatataaagtaatgtaaagtctgtatcaggagttggcaaactttttctggaaagggccagagagtaagtatttttactccagatggtctctgttgccactgctcagctctgcttcgtaatgctaaaggcagccacagacaatatgtaaacaaatggctgtgttccagtaaaactttatttacaaaaccaggcagccaccgacctgtgggctgtagtttgctgatccctgttctatatgaatgagattgcaccatatgtactcatctgtaatctgatttttttgtatgtgagcccaagaatagatcttggactccttcccatatcagtattcaaagaatagtgctattcttttaaaaggctgctagtgtttcagtagatggccctaatccaccctttgtaaccagttccttactggttgaatgtttgggttatattcagatttttgcagttataaggtttggaagtaagcctcatctattaggaccagagagaagctggctcttctcattttcccattttgaagggcttgggttttatttattataatcaccatgatgttttagtcatttagtgttatcattcacagctgagctttggtttggctgactaaagacctgattttggtcttaattctacctctaaatagctgaaaggcttggaagactcatttggcctctctgatcaccatattcctcatctataaactgaacatgagcataaccggccctgccttctgcagagggtattgtgagacacaaatgagataacggcttggaaagtgccttgaaaattatgaagtgatattcctatgtaaggggctatcatcactgtcattatccatgtcattattattaatgtggtaatgcttgggatgatgagctcatctttctcttacgtgtgagtaaatatagaatagagtctgtagttggaatcgttgatgtggttgttgattttccaagcctcaaagtattcagccaaacaattcagcagccatttattaagcctctattatgtgccaaatagggctagccttggtgccaagttctgtgctagttgccagggttatgagaagatcaggtgatgaaccttctcctccaggagttcagaacctactggaaagaaatacccttacccaagttaccaaaatagcgtgatacatgttataaccagggaaagaaaaacagaattctgccagagagaaggtggcattaaaagtgtaggattttgccacacaaataaggaaagaaaggacattctgacatctgtaaagttctgggccagtcattcccagctagggtccaatgctggtgcagcagttacccaaaaacacagttgcctgaacaaggtagacatttatcagacttcctataaaagaaatctggaggacagcgcccaggattgatgagggagctccaccttggctgcttttgtctccctactctaccatgctagtccatggatcccatttcaacgttatctccgatccaagatggcaactgaggttccagccatcatgtctgagttccagactgagagaaggaggaaagatgcaaggaaggaaaggccaataagcatttccctcagctgagtcaacttcccttaaacagtctttttaaaagttccacaataatccactgaagatatttgttaagtgcccaccatgtgacagacactggaatatggccgtgaacaaaactgaacagctgcccttctgaaatctatattctagtggaggaagacagaaaaaaataaggtcaatatagagtcgatgagagagtattaactgcagtggagagaaatatagcagaggagggtgttgggggcattggggagaggagtattgcaattttaagtagctgctcaaagagtgtcactgaaggagaaattgagctaagtcctgaaagaggtaagacagggagccacaaagaccagaggccagtgtcgttggagcaaagctagcatagagacgacaggagctgaggtcacagaggggactattggggccacatgtgcagggccttgaaggcctgtaaggattttggttttaccccaagtgacacgggaggctattggattgttttcagcagacatgatctaactcgtgtttacacaaggaggctgggaaatgtagaatttagctgatgccttcaagctctggataaaattggagttctgttattgatggatgaaggtggggaaagtggttattggggactacagctagttttgcctcttatgagctgtgtgaactttgattccaagttacttaatttttctgaactttagtaagatttaacccactttgaatttataaaaaggatagatgaaacaaaagacatgatgacaggtccctggatctctatgactcacatatgggtcacccagtggccagttctattctggccagagacactaggcatatggagaagacagatttgataaaggaggtcaaggcaatgcatcacggggcacatgaggaaaccactgaggagtgccctgtgacgagtggccatgttgtcggtcccacttgggtttaaatgcagtagtgcatccagagctgctccactctcagctgcgggcaacgacttaaggtgcaggatcttctcacatgctcctgtgcaatagtgagactctcagagttccatcccatcagtcaaccagatgattggcagctgagtgacagcctcaagtagtggccgcctcctgtgtaggtaatctaaaaggtacccaggtgacaaggacggccctcagcaaaattcctcctgagccattcatctctgatgaatgaacactgatcccttctattctggttcttccctccttaactccactctttgaatttctgagtccttctgcaaggactgtcagcacccttttgtgagtccccatctctagacctctctgttgccccccaataatgtatcctccaaaatgctcatcagtcaacctgatactcagttgcatctccctggtactgactggcctcagctgtatcctgttactgcccagccctggtgacaaccctcttgaccatcagttatcttagaacaaggaggacggaggaaaggtaatcatgcatagaagcgtgagcatgggctcccagttgctgctcaggatttccagctgatggtgagggatgctggagagtgtcctactccagagatttgggacttggactagtactctcaagccacaggcaatgtcaagagtggtcttgtttgatgcagagcgacagagtagaggactgtttattcataaactgtatgactgatagggaagacatgtaagggtcaatagccacatgaaaaaaatactgtggttttcataaactggcaagcacccaatacccagtgcagagccctggaaaactgcactggagacatcaacttatcccaccggtcgggtaacccaacccagaggtggaagtgagttttgtacttcctccctgaatctaagtattggtacccatgcactcagaagaacctgcaacagatgggtatgactgggcctgcagaacagatgccagctctactccccagccagtggtacagatggggcagaagagagaggaagagaaagagcatctccaaaagcagactgtctgccctgcttctcaggtgaacacaaaaggccaggaggctgctgagtgtggggggtcaaagatgagtaaagtgatgggctgtacctaagcactgacctttaccacagtgaccctgccggcagctgagatgtggtccagggactgtcagcccccaccagccagagaaacacatgtttcccttggggaggagcaagcaggggatgagagagggcctcagcgattttgctgggcctccttcctctgtgggtcaaggcaagaacatggggggaggaggggaaattgccctcttcaatgtgatttccatccttcaatttctacccaaatttagagacgtttctagacctgaggggaataggagccacagtcacgcatccccgtgtgctctgtggctaattaaagtcgggttctcctcatgggcactggagcccaagaatagcctcctcatgagccctctgtgtgtgtgcacgtgtttgtatttctttttcccagaaaacccgcgggagtcatgttttgatcctggttccatcaagaacggcacacgggtggggtccgacctgaagctgggctcctccgtcacctactactgccacgggggctacgaagttgagggcacctcgaccctgagctgcatcctggggcctgatgggaagcccgtgtggaacaatccccggccagtctgcacaggtggtggaagcctggggatggcaggggtctgaggaactgagggcatgccaggggcagagggtgctgtgggctggggaagggaggggggcaaggtcctcaagcccggctcctccaagcctggcaaacctgggtttgccgtggatgtgtatagaagtggcttataattcactaggtgtgcagttcctttcaaggtatcatctcagaacccatggtgtccctacccccattcacatagatgctcatgccctcaacagaggcccccagacatgccacatcagggagctcacaccagggagaagtcatttaaaggtggctcctggactagttcctaggcctagggaaaatcactgagagatcagatatgttgaagtaaggcccgcagggtgtgctgattccaggtgggtctgggtgagccatgggggtcctgacaagagagataggaatgagtatcagggctttaagagcttggtgaccacccattgaaaagccaagcataccccctttgtcatggtaagagaggcaggctcagacccgccccttgtggaaattgggcaccttggagaggaacagaaggtggctgggtcacatgggctggccactccccatggggttagtccggggaagcttcagctccctattcacactgacactcactgtccaggttagatgtcagccagggcagcagatcatttctaggctccacgtgtaagcagaagaggttcctaatgtgctccctaaggctgtgacttcagggaccaatgccagggttaataggtagagggcaagaactgacacctgcccaagagggccctcggtagcttcagggcaagtttcaggctacatgccaggccaggggtgcacgttcttgggcagggcagggtccgcaggacttgccttctccaagctagggcctgcccacctcagggcagccctactggggccagaagctcaggctggggcagaacagaggatggtcactggtaagaggcccacaaggtcacctgactctctatctggtttctctttcagccccctgtgggggacagtatgtgggttcggacggagtggtcttgtcccccaactacccccagaactacaccagtggacagatctgcttgtattttgttactgtgcccaaggactatggtatgggttttggttgttgttgttcatatgttttctgactcctcaccctcattccaaaatgagcaattcctcagacgcctcccaattatatacagccccattgtgggaatcgcagaacagtctccccaaaaggacggccgagtgctgacgtttctcaaacgggctgcagaatacattccggacacaagagggcagaagggcacaagtgagccccgccagaaccaaggggacagagttggtgagaaactggccaagacagagggaaggcaaggtgccccaggggactacccagtatggcccaagtcctaagggaggtgccgcagatctagacctgttaggaacccagggtgagtggccaaggagcaggagggaggagaggaatgggatggagctgggcttgaaagtgcaggtgagggagaccaggagccacatcattctggtgtcccatctgagaaccaaagcctggtccagaagctataggtaggacaagcaagaaaaaagtgaaaagcagaccagtgccctgggaagacagagaaacttccagattccaagagatgtgggcagaaaaaccaacccaggctcattacctggttggcagtggggacattcaagagtcctgccagccttggaggcattcaggaagatgaagggcaaccaggtgaccaggctggcttctttcttcctggatctcctctttgtaggaggactaacaaccatatctaaacacaattgatgttggatgtggcaaaggacatcaacatgtcccgaccacccaggggaggagcaggacggagggagcagcctgcagagagccagctccttattccccaagacaggatgggcaagcacagagcaaggcctgatgcttgaggcgttcgccaaacatttagtaagcacccattgggggccacgcactttactgggtcctggagttgcagagatgagagagacatgttctctgtcctctataaattcccagtctcatctctacccatagctccagccatcagtacacccactcctgccccagaaccaggacacctatgtacatgtacacacactccccaatatactgaggtggcaggggcctcagacctgcaggatcgcagttagaaaagtcctgaaaggctgtccaatctgatctgctacccagagcagaatccttggtaggtgggcatgcagtttgtgcctggatccctccagtgataaggagctcacagcactgactacagatctctgtatacagttttcaactcaatgacactgactaactgacgttgggacgcatgaatgtggggtcctgacatcgcatggagaatgagggatggtacccaaagccctctgatggcctccagatagctgctgcagctgctatctgggaaaggaacaaagttggctccatttcgcctctacccgcctgacctttgggtgcagccctccatgttgtcttgacccttgtgaaggccagcccggccttcccagctccccgcctccctgtgccgggtgtctggccactgccagactgtgccactgcactaaccagtgcagcaagccacagcccaggaaccaacaacttccccagggctgccctcctcctggcttgggcccctagacccctagatcccctctcctgcccccagcgtgcctgcccagtccccacactgtgtctcctccacagtggtgtttggccagttcgccttctttcacacggccctcaacgacgtggtggaggttcacgacggccacagccagcactcgcggctcctcagctccctctcgggctcccatacaggtatccggggctcggccagtgtggggatggttgtgggccgggggcatcacgtccggctaaaggaaggaggctctagaagcaccccatggccgcaggtggaaccctacggctctgcgtgcctgtcgtgttctggtgcttgtctacaacgcagcagccagctcgtgagagctccaactagcggggccttcagcagctgccctcacccagactgtgtctacaccgcccccttgtggtgtagccttctcctgttggttcgtattcagatgcaactttttttcttactataaatgtattgcattttcattatagaaaacttagtgacaaaacaaaataattgcatacagaatcaaaataaagactaccccgaaagagccactgacaagatgtagtggatttccttccagtctttgtatctacttcgacgtttacatattttattcaacaaaccaatatacatattttattgaaatattcgctacgagcttttctctgtcattttttttcttctaggctaggatttttaagtgctacatagtagtctctcatacagttagttaaaatttatgtaacgaattccctattattgaacatttagattgtaatgttttgtgcttatgaatagtaatgcaatgtattgtacatacatctttatatacatttctgttactttagaatatctagaagtggaattgtcaagttaaaggatatgtgagatctttaaggctttttatgcagattatcaaatatccctctagaaagatcttgtcagtttgatcaccaacaagaaagagggcatgttttattctcacaaaaaccaggtaattaaaaaaacaaaagcgtcatcagtttgaaaagtgaaaatggtatctcattttctaatttgccttgttttattactagttaggttaaatttttataatgtgtttattggcctgtgcattttttatttgtgaatttattgtgaatttgtgtcgatttttctacaagcacttattttcttatttattgagtagagctccatattttataagctacataaatatatataatatgctataaaaagccctcctctccagcttgtcttttgctatataattttcttcagggtgctttaatgtcagaatatgtaaatttcccatgctatcaaatctatcaatgttttcttatatagttttctcctttgcttttatgctggtcaaataaatattcctctgtgttttctttcacttcttagtttcatcacactgctttaatacctttggaatttattttgatttattatttgatatagggaatctaaccatattctttcaaatatagttaatcagttgtcctagcagaattttcaaaatgccaaatttacatatactaaatttttatgaagggtctgttcttagactttttatccatttcttccaagtgtctatttattccttttttagttttaattattataacactataatagtgtttactatataataattttaaatacatggtactataagtccccagagccattctttgttttgaatttttattggctgttgttgcttacttttgcctccaaattatatttagaaatattttgttaagtttaaaacattgcatcagaatcttgactgggatttaataaaacttacacgttaaattagggtgaactcacgtttatattaactcttcttcccatccaggaatacaatatgtctctccatttgtttatcttctgtagcccttgggagggtgctataatttttatttaggcagtattcattgtttgttaactttattcccagatatttcatggagatttttgttgctgttgtaaatgggtcttttttcccccattatgttttctagctggtctttactagtatattcaaagactgttgtttttggcatatttgctttgtaaagtcatcagactcttcataatactgcttacactgccaactaattctcctggctcctctaggcaagaagtaatatcatctgcaaataaatttgtctcattattttatctcctccttttcagtggcttttcttttattttcttccatggttattggtctattcaggtatattactctaatatcaatgttgatattttagcttttagtaaaaaatccatttcataatttcatttacatttagtaccacaatgtatataatgtactatggtgatgtttaccctgctttgtattagtggtgatattcctgcctttgttatcctgcatcgtgcattcatcatcccctttttactcggctgtaccaggtgttttgtgtttttgtgggttttttttaatttttattgctgcaatttatcaattattctgcagtttgttgttgcttttttttattaatctctgcctttatttcatcatttccttcctcatatttttcttctgattattttgttcttgttctaacatcttgaattgagagctctgttcattattttctctgtgtaataaagaacatgtttacagcgatgtattcacctccaagcatagttttggcttcatgccataaattttgatatgtactatgttcatcatcattactttttaaatagctcatcatggtgttgtttactctttttgcccaagtgttggctaagaatgtcttttcttttcccctaagaatatggattttgttcttattgcattaaacttttgtgttaatttatatttttatttccatgtagtgaaagaatgtggcctgtaccatttcttctttggggattaattgaagtcccttcagtagccaaggacctttttttttagttttctaaatatttaagaaggatgtgtgttctctgtaaggtagagaagcaagacgaatgagctcaggctctacaatcacactcttttcttagctctcctatttgttttctaggtgacttaaggcacaatacttgacctctctgagcttcagttttctcctctgtaaaatgcaaagaaaaagagtcctacctcctaaagttagtgttaggagtaaatgagttttgtaattgccattaaatcaatcttactcaattttgttattcagatctattgtatcagtgattctcaaccaaatgaattttttgtaaccaccacctcacacatacacacccaaccaagagtgtaaatcaggaactcctggagtaggatgccttttcaaaacagatagatagataatgtatagctatagatttagagttatagtaaggattttcaagtaaagagctatagagaggtctacatttaagacctatagatgtaaatatggatgtagatataggtgtataggaccaatagaaacaggaagtaaggaaggaaggaagcaaggaaggaaggaaggaaggaaggaagaagatgggggaggaagatgagagagtgagagagaaagagagaaagatgtataagacctgtagatataaaactcctgacctcaagtgatctacctgcctcagcctcccaaagtgctgggattacagtgaaaccccatctctactaaaaatacaaaaattcactgggcatggtcgtgggtgcctgtaatcccagccactcgggaggctgaggcaggagaatcacttgaacccgggaggtggaggtagcagtaagccaagatcgcgccattgcactccagcctgggcgacagagagagactccgtctcaaaagaaaaaaaaaaaacctgtagatatcaatatcagtatattcagagagtcccttattcctcatttggagaaacactgataacaagccattggtactgatgggagtgcactatgtccctgtccctgagttgcgttgggggagaaaaagcttaaggaccgctactcaacagtcttcattttgtttttctatttgatgtatcaatgattgtgaatgttgcatgaaagtatttcccattacagttatgatattttgttgtcttcttgtatatctagcaatttttgcatctgttttcctgacatatcttctctcattttctccaagtctttctcttttaagaggaagttgactcatttattttacaagtgaattatttggtctgatatctgtcatcttgtgttgttctttctgcgcttttgtttgtgttgttttgattttgcttcctcgcttttccatacatacctgacccatctctaattttcaagtttttcttgatatatttggacttttatattaatgttatagtagttattttttaaattgtggacttcttccccaagagcaaatttttgaatttgcatttgcattttgttttgttagctcattgacaatagttattatacttttctggttgtatttatccctgctggtgtctgaattccctactttagttttgggttttgtttttttttttttcagtagggcttataactgcagtactttctgtaccatgcatatatgagaatgctttccttttgacatgggatataaatgacaccttgattgtaaatcaaattacgggtcaaactttatctttcaaaactgcagtaattattccactctattccaacatttactgttacagacaaattggggtccaacgtgattctttgtccttgtaagtaacctgtgcttttctgtctatgtgattttctttttttgttgttgttaattaaaaagcccactgggaggtgttgtggtggaggtctcttctcactaattctaccttgcacttggcaaatatttcaatctgtacctcacatcttaggaaaagtgtcttctttcttaaatgattttttttttttttttttttgagacagagtctcactctgtcacccaggctggagtgtagtggtgcaatctcagctcactgcaacctctgcctcccaggctcaagagattctcctgcctcagccttccgagtagctgagactccaggtgtgctccaccatacccggctaatttttgtatgtttagtagagatggattttcaccatgttggtcaggctggtcacaaactcctgacctcaggtgatccgcccgcctcagcctcccaaagtgttgggatcacagatgtgagctacttcaccctgccttaaatgattttttttctccttcaatttctctgtcttctctttctgaaattcctgatacatgcatatggatttttttttcatctttcacgtcacttgtcatttctctcgttattttaatctctttatcctttttctgtggattctgagagaatttcccaaatttcatctcgacttcactgttcagtttttgtggaatccagctgcttgcactagcatttctcatctctttgcagcctttattgatctcagatccttcttcctctgacttcacagatgcaatgctagatttaatctcatgacaaccatgactgaacatctgctgagagttttgcctgttctttgttgtggttcacataaagtatttgctttgacttcttagagtgatctccttcctcaaaactttaacattttttcttatgtccagtgattttactatttgctctcccttgaagatggaggcccgtgtgccttcagggctgcagttgacatgggttctgtgagagctcactagggtcgttatccacatctgtcaggccaaatagaaaagttgagtttcactctgctcacatccatctggaggaggagttggagatggcagtgatatcaaagggatgctttgccttcatgagtttctttctgctttggcagctacatgttagctgggggcaataactgttagctgggacaatgactcctagccaggctcagccttctgggtcacatacacatctaagcctgccttgcaaaagctctctgctcccatattggtggcatcacatgagcttcctggaagtacaggtggacctcccagtagttccgttgtgggtcccaactctagccctcactgtagtggagatagagcctggttctctgtaatccctgcttcgtcctgagaatggggtctggggtcagcagcgcttctcaggggtccctgaggctgcaggggggcagcaggcagagtggccatgctgctgcctccacccatgttctccctgcgcttccccagaatggcaactacactaattggctgcaggtccagttggtgctgtctctcccctggcccatctgtactgcaccaagcagaagatatacctttgtcttctgctacaaaagctgtcagtctaccctggtttcctgtgcccatgcaggttccccccagtttgtgtgttattggccggcaatagtacatcctggtttgcctgggacagtcccaccataactattgatagcactttctttgactctcaaaaatgttctagtatgaacaatacattacaccatcgctctggtaatcatttcacaggatggtgggagagtgtctgggaaagaccagttgctcctagatgatcacatcatcctccttcctagaggccaatgctatttttaaaaactcagattgatgtcagttttccaagtaaaccaccagtcagccggcttggtaacagctgctgtctccatccctgtcgctccacacatccctagcagccttctcctttccggcacaggtcatttaatctttctggacctctctttccttctttattaaatgagggtactgaactctgtcatgccaacctcacagtgaccacaggtcaagttaagaccgtgaatgaaaaagctttctataaactttaaattgtaaagtgcagtaaaaatacgtgagattttatttcaggaaggcctggaatgtggaaggaattgctgcatggggtactggcagcccctccttcctggccaggattttatcttctgggcccacctgctggactcactgttctctcctccttgccccttatctcggcaggagaatcactgcccttggccacctccaatcaagttctcattaagttcagcgccaaaggcctcgcaccagccagaggcttccactttgtctaccaaggtatggaggacatggacgccggaggtaggaaggtgatctcggttcttaagggactcgtgatcgaagggacagggatctttgacctctagtctgagtccctttctcagggtgtttgggggcagttactagtttgtagggcaattccctgaaatccagttaattttatgcattcacttactcagcagacatttcttagacaagttctgtgtttaatgaggaaggaaatcagacaaaggcagccagttttttccccttccccactccacccattgtctggcatggtccagatggcactgaagagaccagcccaggcatcttacctggactcccctggagcttggttttgtctgccaggcacagtaaaggtgcggggaaaacacaggctttgaagtgccgtggacatcgatttgaatcccacctccccaccttcgagctaggctccagctacgccaggcctcagagcctgtttgctcacctgtaaggagcgggcaatcacaatgcctcactgataggatgcaaagaggcttcgggaagtagctggtaccaaccagccagttggtgttagttcccttccttattggcccagaaaggtagtttggagcatcctggttttcacccccaggtcccaacctctgcttgcccaggagaacatccacttttgtagggcccaggttctaagcatggtcctgttcattcgactctgcccaggatgagctgtgtttctctttgcaggagtgatcctatcacaggggaggccatcccgggcccatcagccattctgggcggcaggagggaggggagactgggggtcatggagggcagggccccaggcaggatcttaaggcacatggggaaaacaggacagaggcagggcaaaggccctgaaggtagaggaggaaggcccattctccttgctagggaacgtgggaccctgatgagtgaggggcgtcgttgggaaagcaaagaacaaaactgggcctaaggtctgtgggaggtccacggctctacctcccgtgctttccaggagctgtgctgtagcgctgtgtgtccaactataattcggtataacaggcatcctcctagttagccctcgagcccttccctacgggagagcatccagagcctcccagggtttcatccagacggtctttgttccagacccgttgtatgtccgtccctgggccagtttctgaggggtgaggcctcccctcagtgcccttgtcccccacagcggttcctcgaaccagcgccacgcagtgcagctctgtgccggaaccccgctatggcaagaggctgggcagtgacttctcggtgggggccatcgtccgcttcgaatgcaactccggctatgccctgcaggggtcgccagagatcgagtgcctccctgtgcctggggccttggcccaatggaatgtctcagcgcccacgtgtgtgggtgagtaaccaggacccgggcgttgagggtgcggggggcggcacgtagtcctttctctgtaggggaggcagtcagccccagtgatgccccacgacacacagcagccgcttcccaccgcatggctgaggtggggtgtcccagtcaaccccagtccccggcgctgtgggctgtgtgaagacagccggtgtactggggacggggcacacgtggagagaggagctgggcccagggccccgaacagagttgcatggggagaggccgtggagaaggcaggactggggacattagggagacacccccatggggaggaggacaaacagaggctgggggccatgagggaggagtcagcttgggaaggctcccacgggaggccacaaagcctctgacccgatggcctctcctcccagtgccgtgtggaggcaacctcacagagcgcaggggcaccatcctgtcccctggcttcccagagccgtacctcaacagcctcaactgtgtgtggaagatcgtggtccccgaaggcgctggcatccaggtaggggcaagggggcgcctcggtcgggcaggtggccgtctgctcccaggtaacagctcacaggtgacaaccacaggtgctggctggtgccaaggcctgagtcagggtgagccaggaagagacatatcagccctgtacctgcccctgcggctaaggaggctcagtccaagtgtggagatgtggctcccatgcagaaaacacagcaggttccaggccccaagagcttcagggacatgcggtgggagtcgggtaacccaggaaggaggagaggtgggcattgattggccatggccaggaggggaggctaaaagaagaaatgggcctggagctggaatctgaagtgtgggaaggattcatagaagttgttcctcaaatggctaaagattttcttaagattgtgagggttagaaggggaggcagtgctaatgagaagaaagagcaaagcacccagcacagctgaagcacagagaacccccaggcacacacctagggaaccacgcacagcatgagctgtagaagctgaactgggggcataactggtacccaggggtaagagccaggcagagggaggccccagcattggcgtcaaggcagggaagagggtcaggagcctgcaaggccaacagagaggcagcaaactgggagtccagcagacagatctgggcaggagtgggttacgggctcattgctgcaggacgtctgatgaaatcaaggcaggaaagtggggaaacccaaggaacattccagagatgaggagacagtcagtgagactgtctttccacttcctggaacttcttttccccattctctgccttgcaaaatatccactgtcttctaatcatttttttccacatctgtcttccccactggacaacgagctccttggagtcggttctgcatcttacttttattgaaagggactagcacagtgttaggcccagagtagattctcaacaaattgaattaactacgggaagggcagaaagggaaagcagagaaggagggagggacgcaggctgcctaaccaacaattcactcttctcccttcccagatccaagttgtcagttttgtgacagagcagaactgggactcgctggaagtatttgatggtgcagataacactgtaaccatgctggggagtttctcaggtaagctgggtttccaggggcttcaatttggagggtagtactagagctcatcatcatgaacattgttattatcattattattattgagatatcacttatattccatgaaattcaccattttcaagtggacacatcagtggttttcaggagattcgaaaggtcctgcaaccatcactactatctaatcccagaacattttgaccaccccaaaataaaccaggtacccatttgcactcccctccccagcccacacctagcctctagtaaccagtaatctactttctatctctctggatttgcctattccaggcatttcatataaatggaagccttctgtgtttggcttctttcacttaacgtgatgttttcaaagttcccccagtcacagtatggttcagcacttcattgtaaggacagagcatattttgtgtgtccattcatcagtcaatggcttgtttccacttttgtgctgttatgaataatgctcatgcacaagtcttggtgtgaacacacattgtcacttctcttgagtatatacctaggagtggaattgctgggtcatgtgggaactctatgtttaacttttggaggaacttcctgttttccaaagtggcaacaccattttgccattctagtaatggacttctgactgagtgtggtgtataggtgtgcccagtggccagggcaattatctgaatcttttaggcccagaactctaggtggccaagagataaagaggagtcacatgcttcagataaactgtccacactgcaggactgcccagagaataatacaggtcagagttatcctgaagatggctatgaggagacccaactcatccctcaccctcctgcgggcacatggctctgccactgctcatcttacaggaagcagattggagtttcccctccctcagccagtagagacctagccctctgaggagtgctaatttgtcatttagtgagtttcataactggggacatctgggggccttgggagcagaatgtcagcaggtagcaaaatccagaggaatggggaggaatgcaagggcctggaggagccaaacttaaatggttttccctggtgtccttgccctaggaacaaccgtgcctgcccttctgaacagcacctccaaccagctctaccttcatttctactcagatatcagcgtatctgcagctggcttccacttggagtacaaaagtgagaatccagggtcttggctggtacagggttcagggtgggacctaaaagttgctgagccccttctgagcaaggattaaactggagctgcatattgtccatcccacttaagccttcccacaaacctaggtgaagatgctaaagcccagagaaggtctgaaacctcctcaaggctgtgttctcgtccaagtgtctgttactcgaaaacctgtatgcctgttcagtatccacaccaggaatgggaaggggacttgcattggccaaggtcccagtatataattgggatgtaagaaaattgtgctttcctcccccaggtctaaaacctggcctttctaacccctagttctatgatgcgattatttttgaagttcctcctttcattggctacctcactcatcttctaccagatttctcactgcaggctcaaacccttatatcctggcttctggcatccctaagtggtcactaccaaatactcttcacagagaaagatttgtggatgtgccttctggggaacaaagaaagaggtttctagggaaactgcttgcatactgggactgcctgccctaccccctttctccactgggtacaggaaagaataggtaggcagcagcattttttacacttttattcggcaaatatttattgagcatttacaacatgccaggcactgtgctgggttttgccacgattgggaaagattaagatgggtcagtcaaagtccactaaagagaggtagacacatagacagagaggtgcatgacagcattacaggtgctctcatggatggctctagatggtagagaaatggttcaagggagagaatggttgtgggcgggtggagatgcaaatgttgtgaagaaacattgagcacctgcaatgtgccccgccctgtgttaggtccccgcagtacaaaggtcaataagacaaggcccctgccttcaaaagcacaaaatctagaaggagagatggacatgggcacagtcattttagtgaaacctaagaaagtgcagaggaaaggagagatgctaagaaagtacaaaggaaaggagctaaagctagccatgtaaggccttgcagaaggggatgcctgagttaagtttgcaatgagaagtgaaaaatgcaggaaggcatggttggctagaccatctgcgacagcatgggcctgtgcagaaagaaggcccactgggtgctagatgtctgattgggtcagaactgtgttatgcacatgcccatctgggtctgtgaaacaaatgaacttcatccagctgcttcagaaagaattaaacaggtcccaggatgctcatcacctgaaagaactgaagcatgcacctggaaaaaaaaaaaaaaaaaaaaaaaagacccaggacagctagaagcagaccctgcagggtaaagggtaggacagggacctctgagactccttccagcagatatgtaaggcttcactcccctggtggagtgaaatatcctgggtttctcgactaaatcacatttttttcctttcatcccttcttctctgttctctccagttttctctatccaatattttgagctcttaaatgttccctagaatcttctctgttctttcttcttccaaagatacattttctttgtaaatcactttgccattctactgcctcattcccaggaaaaaaatccacctcttctcaattttcttcgtccaaggggactggcagttttcccagtagctgacatttcatgtgttgtcccctcatgatgggaagagctacggagaaacagagcttcccactggtatttggagactggaattcctaggagccagggccctgtagttatattttattttgtaggataatctacaaagagctcacagacaatagagaattaactgctattgtacaggcaaatggttttgaagggtactgaaaagtcacatccactgctatgattcataattgtttatttaatttaaatggaaatggagcaatatgctttcaaaagtaataaattacatatgataaaaaataatttttcctttgttgtaagcatggcttaaataaaatcaatctgtgtagcataagataagttagaatggacttttctatatccccctccatttttctcttcagcctcatctttctcccattccatttttcttcctaccacgcttttttgtcctcattctgctcttctctccatcactggacagtaagtaggtctttccaataagtaggtctagttagttgcaactactgcactaaatagtgagttttgttctacttggagtgtggagaggaatggggagaaatagacaagatgacaagtgaaacacttgaaactcagtttgatgggttttttttaatgcttgtccttggggtcttttgtctcagctgctgagagttttggacaaggctcaaagagttttcatttccaaatatcacactcatatcttaaaagcacatgtgggacaggaattgcctgggaaaagtgtgaggaatttccagagtgatagcaacgttctgtggttttgacaggtgtttgggttacaaaggtacaggcatttgtcaaaactcagcacatgtacactcaagattatgatgtttacttgattattaccatgttcatgcacagtttttgcattttgttatatgtgagtttccctcagagggaaaaaaagcacatgtagttatcagagtctcatctctgaatgtggcatgaggactcattagctgctgcctgggaagatgggttggtggctgatggtctaggctgattggtcctttcctgtttcttttccatgagcccctagctgcctgtgggcactggatacacgtgggctcctcagggagcctgtatcccccaaaggagcctgtatcccccaagggagcctccagaagggccaaggctgccatctcccacattctctgggccatgccacccagatacggtctgccatccttccatttctgccgccttggttaggaagaccactttagagtttacagctacctctccgcctcctcatgagtcttctggcccttgcccctggacaagtgccctccaagtccagtccagcaagacacagaaactttttagtgcatgtgaagtgcctgcacctgtacatggactcctgcagagcacaggagaggcaggaagccccctgtctggaaatgctacactcccatttgctgtgtgggaggcagccagggagggattcaaagcaggatgaggactgttttaggaggggaggcagggagagcaggggacagggtcagacatgggctcatgtggcctcagggcttggcttctgcttggccgacctggggtcagactgggcttggtctgaatcctgggtctgtggcttactaaggaaatgtttcagtgcctcctatggcctgtgtcctcatctgtgaaatgggatgtgaagacctgcttgaagggtatgaggggataccctcaccaatgggccccagccttgctcatggaagtgctcagtgagcacttctcttgggaagatggtatggactggcagaaaggaggaggaggaagattaagctgggtgctctagcaaaacattgtgtgcaatgccaggcatgtaatgaggaataaatgagtgcaggttgaatttgaaaagtcaagaaaggagactgaaggaggagcatttgagatcctgtggaggtgatcttgaaagaggactaggccaagatcatgaaagtccttagaacatcaggatgagaaagttggattccatattataggccatgaggacctgcttcaaatcactgagcaaggaggtcccacaattcaaggagagattttaagcaacacgagttgcctgtgagtgcagggtggactggactagcagtggcttggggtaggggatgaaggagggttttagcggggccagtgctcagtgaggccagagctgaacacgggagttgaagtgtgagaggccaccagtgctgctcccagaaaggggctggcctgaccttgaaaacacaacaggagaaataaggcagtggagagtcttatctgctaacacacttttctcagagtcttggaaagtcggactctaactgagcccctgagcatcgctgatgtgtccctccctgctctccttccttcttgaccttcttttccctctctctctctctgtctctctgtcttagcccacaggatctgtcttcttagggtaaggaagacagaggggagttaagagtaagaagcaggagggatgtgggaggagagcatgcagagaagtctccctagctaagccccctagctaagagctcagtgagtggacaggacagccagcatcccctgggatcacacccaccttctcaaggagctttggtctgttgagcctccgtgccatgtaaatatactctttttctctgtgtgctgcaaggtgaagagagttgggaagaactagcctacaggatgagagaaagcacaaattagaagcaccccttctccctgccaccagcatctcaccccagcctaccgccacgttgacctgctgggctagtccattctcctttccttctgtctctgtcttgtctagcggtgggcctgagcagttgtccggaacctgctgtgcccagtaacggggtgaagactggcgagcgctacttggtgaatgatgtggtgtctttccagtgtgagccgggatatgccctccaggtacctcccctgacaccctagagcaggaaacaggtgtcccctgagatgtggttggccagccttacaccagcagagctacagtcaccaaagaacagggagcagcccccaggtcccccgggtaccattatcctctcctggagctgttcatgcaaaagataaactctgctgactttaacaatttggcacaagccaacctccaatgtgttcctgcaaagttgggtttgattcggctttagggaaatttaatttccctttgaaggccatcagggaatttagtaattaaaggactctcacaaggaaacctctaataatgagaattctttagtaatcgttgttaataattgtccttccccaaattctctctccctctacctcactcccatcccacagtggatctgtgtgtctttgtgtatcttgttccttaacatgaggcccctgaaccagacccctgtacagcccctggttgtacatacaattgtgcccacggggacagctagcccatccctgttcctgattcctccagggccacgcccacatctcctgcatgcccggaacagtgcggcgatggaactaccctcctccactctgtattggtaagacagcccagactttacaattcattccaaccaattttctctcagggatcttagctcagtagtgtatcattgagttcaagttcaaatcagaagaaagtttgatattctggatttgttccaagtcagtcattttaaactgatgtttttataatctctaactcccatttaatgcagtcatcacttttggaaactctgccccaccaaatgaaaagttacaggaggtctgcccatttgaaaacatgatgatgaccgttctggctctagttaatcaaccagatcccagatggaatttctaggcactttgggcttcccccgtgacttcttgtgggacagacagacaaatctaataaagaaatgatgaggttggccgggtgcagtggctcatgcctgtaatcccagcactttgggaggccgagtcaggcggatcacttgaagtcaggagttcgagaccagcctggccaacatggtgaaaccccatctctactaaaaatacaaaaattaggcagatgtggtggcacacacttgtaatctcagctactcaggaggctgaggcaggagaatcacttgaacccaggaggcggaggttgcagtgagctgagactgcaccactgtactccagcctgggtgatagagcacaactccgtcccaaaaaaaaaacgaaagacaagaaaaaaggaaaagaaatgctgagggctacgtgcgaaacaaggacttggcttcgtcccttaccctgtgctacggcagtgatgagcagatcagcagacacaagaaaagacagcatctccccttcagaagcttctggtccagttaggcaaagaagaaaggcacatttatttaatatctactatatgctaggcatggagcttcatatttcctcagatcagccctgcaggggaggtaccattaccctcaatttgcaaacaggaaatctcagtcttttaggattaaaaaggaagtggcagagtcaggaacggaaacctaaggttctctggtgcccagtcgattgtgaggtgcccctcaaggctgaccttggggcagggaggtaagggagtgacactcaagcacgatggcatttctcttctgtggtttcaccacggtgtagggcataggcatctgtggagcaggtcagaaatgtgaacggtcagcccaaggcactttcccccattagagactacaaagaccttgctatggaaaccattcatttaacggcagctgctgttcattaggggtttacaacatgtgccagccttgtcccaagtaaatgcagtcctttctgatatgacctcacaacaaccccattagaagggtgctgtcactagttccattttacagttgtgggaaaccgagttctggagggttttgaacttgcccacggtcccatcggaagtgaaggtgggattgtgacacaggcagtcgaggctggagcctactctgcactgttttcgggtctgtttgccaagctgtcctctccccagaaagcacttgcctggacctgccaatccctgttctatgatcctttccctgggtctctaagactggctagcccctttctgttcacacaaccttttcctaataagatgcaaaagaaaagaactgatgtcaactgaccagactgcaggggtgccccagccctgcatcctcagatgactctgaattcaccttgattggcatatcagatgtccctaagcccctgggtcactcagacagcctggtggttggctcctgtgggatgctgatcaccgtcacttttctgaggatgggctcgtggtgagcctcccctgccgcccaccctgccccctgaaatatatatttgagaagagcctggcatggtgccgggcacagagtggggacttgatgcatgccagtccccttccttcatcctttttctgcagtcttgaaagagtagattgggcagtgaggagagggagatttgggggatacggtaagaaatggttggacttcttttggcacagaacttcctcacttttcctggacatcctcaccagggaactgacctgtgaagggcatgttcaaggtcaagagtccataacttgggtttgtggacttttaggctgtcctagaatgtacctcccttcctgaatgtacatattgaatgttgcccgtgggcttagtcttttaagaagattcctttggattctcaaggggctatatgactcatgaaagcttaaaaactgctgcttgaagggagcttccaaacattggcagggccctgtacaccccttgatgttgtcctgaccctctgtctcatctcattgtcacagcacagtgtgggggaacagtggaggagatggagggggtgatcctgagccccggcttcccaggcaactaccccagtaacatggactgctcctggaaaatagcactgcccgtgggctttggtaagtctctgcagcccccagaggagacaggcttcaagcccagacccttgagcttaaaactactgtccgccaaaatctcttagcacaaacttgggccaagtctgtttagtactctgcctctctgttttctcatctgttgacctcttgtacaattgtgaagaccaattaagaatggcagagattaacatataggggggagaaaaatcttaggggttgccattattattatttgagccataaactaaaatccaggaatgtggaatgagaaattactcggattatacctaactaacactgtatcacttgatattaaaaataaaaaataaaaataaattactcagggacttaaaaaaaaaggcgggggtggggcggaaatctgtcgtacagagactggacctcaagttgtacttttaaccccagtgtctaatttatcatcctaattaaattgagccaaatcaatgagaaatcgagtttgcattcttcttcgtatgcacattctagctggcctagagactgggaaggttgtttttttggttttggggggttatttttgttttgttttgtttttggagctggagtatgctaggcatgggaggttgtcagggtgtggaggacatcagtgtgggtacaaaatgtaattgctggtgatccacatattatgcactgggaatatcatttaacccaaatgtctctgttgaagggatgagggctttgtgctgacatggaactgatgggccgtacgcacgggtcatcttgcccaagccattgcactgcttctaggaatgaaatgtcccaaggggattatgcctgcatagccctgaatgccagtctgtgagcctcagaaatgaagatctcccattttatccttcattattcagcctggagtgtgattagagattagggaaggggcttttgggagaaagcagtctaactggccttctctaaatccggttggaggggaggagagagcttggtggccctctgaaagatgttattttctgttcagtaccatcttctgaaggaaactgggtgttcagtaccatcttctgaaggaaactgggagcaaagcgatgacgccctcggcagtcttaggagactccagactttgagacattaagaggatctgggagaccctgtacctctgcatccagtcttgaggcagaaccaagatgatagaaggtggggagggcaacatccaaaggcaaacagaagtttgaatgaggtggctttccctgtaagtccttatgttcagccaccattttcacctctaaattctgggtgctaattcaggtttcagggaagaagctactgctgggtccagttgcaaaggcccgggatcccttgctttcaagttaatgttggattctgccgaggtccctaacttggtacctggtctcagcgtgtaaagagctgctgcagctacatgctgctccactagatggcggtcacagtccagttctttccttggagttcaagtcagaaattccgccatccttaaagagccccttctgtgggcctgcagcccgcagggctcctatatgaggggacgatgcctgggcagtggaatggaaagcacaggctcctcagataatgtatacaaagatgtcatcacagcctaacacggtgaaaacccgtctctactaaaatacaaaaaattagctgggcctggtggcgggtgcctgtagtcccagctacttgggaggctgaggcaggagaatggtgtgaacccgggaggcggagcttgcagtgagccaagatcgtgccactgcactccagcccgggcgaccgaacaagactctgtctcaaaaaaaaaaaaaaaaaccatcacaaaattatctgcaacttggaaacaatctgcatgttcatgagttggggagtgaactgtatggttggataattcataaaatggaattaacatgcagttaaaatgaatgaactatatttttgtatattaacatggatagaccttgaaaaacacaatattatgtaaaaaactgtatgtacagtataatatcatttatgtaaatcttgaaaacacataaacccagatacatatttaagaatccaaaaccatgaactggaaggatagcttccaaattcatgtgattgcttctgtggagggcaggaaaggaatggaacagggcaggagatgaaagatcttcaacattaagtgtcgagtctttattttattctttaaatgatcagatgcaaaaagaattatactcgtgcttattctgagcttatttgatagcacagataagccaattttaaaaatgaaaatccatctataatctcatcgtgcagcgataatcactaatggcttagtctcccagcgttaccatgtaagtctcatgaagacaaggaccttcttgatcttgctcatcctgtacaatgcctagcacagccctgatgtacagcaaatgcccagcaaatattcctagcaggcaaattaatattcttccatgttttataatacaaaaattagaattgtatacagcatactatttgtcatctgatttttacaattatcaatgcaatatgggctttttcctatgctcagtaaatatatttcttcaataacattttccatggtgatctaattttgaaaaatcttatcagtaaacaaacataaatgttcccaccttcgttcttgaaagagtatattactatgtacattaagaacttaattagatttatttaacctgtcaggttgctagaatgtcttgattaactcactaagatcccaaagtagaaactttatttggcttctttatggaacagaggggacaatgtatacttctaagccctacgtttctgaattatcataagagttctagaaaacagcagtattgaaggtcttgtcttttgattaagtattgggggtgttatttttaaatgaaaagtttattctagcaaaactatctttatgctgatattggacatatgaatcataaatttaaacaagtgttgaccctgaactttgttttcaacaaaataaaatgaactccagtggagctctgaaatgactgatgcctttatttttgaatgaataatacacttttaagttcagccctgtcaaagacaagagacttggctggacgggcaattcccaaagccagttctaggagccttggctgggtgggaaatcagtagcagggactcatggctctggcaggagctgctttcatgaggcagcacacttgaggcaggactgtgttgctttgggcactgtctgcctctgtcttgctcccaggagctcacatccagttcctgaacttctccaccgagcccaaccacgactacatagaaatccggaatggcccctatgagaccagccgcatgatgggaagattcagtggaagcgagcttccaagctccctcctctccacgtcccacgagaccaccgtgtatttccacagcgaccactcccagaatcggccaggattcaagctggagtatcagggtaaggacaaggagcaccgcctttgcttctctgtctatctccatctcttgccccagccacccaccttcccagccttccatgtgggggaaaacagaacaccataaggggtgggttgcggtggcaggcccagtcagggaagcttccttttggtggcagatctctccggaccccatttgtcagcttaagttctcccacagccttttcaagagtggcaggcccaacagcaccctctgaggctcccactctgtacagctgtccctgggcaagtggcccatctgtgccttctcaggtgtcccaaactgtccagccagtcacttcccctcgggcttgataaactgaattacttccccagggtccttccctgcacatcaagcccaattactctcagcaaagctcttcctatgacaggatggaggattctagtaacagtcccaagggcacctctaagccttgcacaaggagcaggttttcctgtgaggcccaaccacactcaccacagctccacctctctgaagtgggatcccgtgaccggccccactcattctgggacattccctggaaagagccccatctacactcaggttcccctgtgttgtagaccatccatcacctgtggatgtggagattgtgcccaacctgtgcagctgtacatggtcctgagtaagcccaacctcgcccttggatgcttcccttattgtgactgaccgaagcatttgttctaatccctttcccagattcttccactgaatttttaaaaatatttttagattttttttccaatactaattcatgtttgtaaaaaaaaaaaaaaaaatctaaacactgtagataattttgtgagcacattgtgttagctcaggctgctgtaacaaaataccataagccaagtgccttacaaacagcagaaatttatttctcacagttctgagggctaggaagtccaagatcacagtgccagcagattccgtgtctggtgaagacccactttctagttcatagacagtatcttctcactgcgtcctcacatggtggaaggggcaaaagagctctctcaggcctcttttataagggaactaatcccatttaggagggtgggccaccaaatgccctgcctccaaataccctcacatgagggattaggtttcaacatagggatttgatgggacagaaatattcaggccctaacacccgtcacaggaagtcaaaatcctcccataatcccatcctgtcactaccctatgcagagatacacactttcaacaattcaatatgtattccccgcttttctcggtatatatattgctgtagctatatttttagccaaaattggatcgtactatagttttccaattttgttttttaaagttaatttttaattacacaaacaatttacaaacatatttatcttttaaaaaaagaaaaatacaagaaagaaattaaaaccttacaagtaaggccaaagctctctttgtctatagcctccaaacccaggattattctccagaaacggctactattgtttagttgtgacctttccaggcctggatatatgtatgctacatgtacctgtgaaaaatatgtaacattttataaaattttttgaccacgttttctatataaatagtaccatcctatatgcagctttctgagagttgacttctttattctggaaataatatggtggggatggagctcctcccttgccagagaagaatactgagggggtactgggcttctcatttagggaaagccttaaagggcatcccacgaggtgggtgcaactgaatcagttctgcaggagacttcagggttccggggtccatctcagggaaagctttggtaagtgcggctgggcttgtcatctagagggagcctcaggagaagctgggccttgcacccagacagagccacttcactggtgttagcacagctgccacacccagggaaggtgtgtgcaggctcatcacagaggccagccttgcccaaggatgtctgtgcctattatctgggaggtgtgtacctgtcaaacaggtcatgacgcgtcggatggccgtgatgtcacaggagggacttggtcccaaatatgtcctctcagagacagatgcaacgccttcccccaaggctttcctgtgtcttagtttgttagggctgccataagaaagtaccacaaactgggtggcttaaacaacggaaacttactgtccaatggctctggggctggatggtcaagatcaaggtgtcagcagagttggttccttctgaggcccatgagggagactctgtccgggcccctcccctggcttctggtagttcatgacaatcttggcattctcagctcttagaagtatcaccccgacctctggcttcatcttcacatggtgctcttcatgtgcctctgtctccaaattcccaccttctataaagacaccagtcatattggatcagagcccaccctagtgacctcattttaatttccataagtttggtaaagatcctgtctatttcccataaggtcatattcacaaggagtgaagtcttcagcatatgaattttgggagacatatttcagccccttgcacccctcccaggcccaagtgctctctccctgagaccttccttctcggataaatataaggaatggcagtgccaccattgtgccagggacagctgccctgggcccaccccgtgcactgtgccttcaccctagacaatgggcacggtcctgccactgaatccctgtgatgggaccagccactcgctgtgctccccgtgtgatgagcccacttgtccttgtaaaggttgtgcctgtgtgaccgcctcagattctccattgactccctcgacagaagaggcctaactacccccacagagccctggccttgggctcactcgcccctgattccccagcccccatctttggaaatgctcccactatggccaccctgcacaaggggccccgctgtccccctgaggtttcctggacgacaagccaacattcgggactagtgtccctccctgggatgggcctgtctctcccactgaggtttgcagcctccacaggcccagtcctcctctgataactttccctgcgtagggaggccagggggcagcgagttgccttcagacacccagctcctccaccaggagttggcccaacatgtgagaggcacagcgacatccaatggggcttccaccctataatgggccccctcctcccacaagcatgtgaccttcaggacttgcctggatgttccccttcagtcccaggcacagccactccctcagcgttcacctgtctgccacagtcccaaggactcctgtggagccacacatggtgccggggcacctgctcccctcagacttgggctccacccctattaaggcttctcgtttggggcgatcccaacctcttgggctaggttgcctctagggccagaggcctaagtattcccacagaggcctcatcatttgtgataggcccaaataactctccctgaccataagcccacactctctgtttacaccttcctccgccgtacggagcggcacctcgtaagcaagctctgaccactctccccaggtttttcctctggggaaaaacccagcttcaatgaacgagccatttgtccccactgaggctgtttctgtcagacccagctctctatggcccctcgactttccttagaagtccaactctttactctttctcaaaattcctccaactgatactctgcacttcccatgctagggtcttcttttctcttctttaagtaaagattcccatcaagttcttagtagcagcataagcaactcctagccaggcctcccggtccgacatgcttaatgtgttccatgacaatttctcaggagggttctgtttataaagaacttagcaaaatggctaagatgtacaattgtccccaaatgctaggcatcatcattattaatgttttaaaataatggcattttgcttgaaattgtatctacctgattatggcactttgtttggaagtgtgttcccactgtcaccaggtgtgtccctttagaacaaacccacttgctttcctgaggagtccttctttggggaagttcatccttcctcctcttagggtttatttctgccttatatggccaacctctccctttgaagcttcttgcaggggaacaggctctgaggtttctctcagtgttgaggtactctcactgaagtttctgtctttttgaagagcctagatccttccactggagatgattcctgtaggagaggcccagctgctctcatcaaggctgctcctggcttcccacacacagccactcccttccttctctccccgtctctgagtccacgtggctaccctgagcctttctgtaaagacccaacccatcccattgggttgcctccctgggcaaaaggccccctgcttccgctgagactttcgttgccaaacggcccaaacccccgtgctgcagggccaggcctgtcctggggctaagcagccaccccacccatgtggttgctcagtttttggcacacccaattacctcaatgatttcccagggaaacctgcccagttcctccccctgagacttccctgtgaggtactgaatggaaacataacacagccacgtgagtgctcaggaaatgttatcttcaagatccgcgttattgatgttgttattacgtatgagaaacacatgtacttctaagaagcatctatccagtcccaactacttccactgaggattcccactgtaggaacgttctgtctcctcccgctgccaatttcctgagtggagtgggcgcaattactgccacgaaggctgttctgtgtcctgtggacccaattcatcaaaggccttgctcaggaatccctcagcagcctctccccaatggactggcctcagctgcttccatggaggcatctcctgtggagtcaggccacccactctcatggaaacagcttccctgccctttggagggacttgctttgtgacagccacacgtcccttagcccagctactccctctgaaaagcttctctccttgccacagatttgacttactcccaccagatttcttccttcctgagaggttttgatctctcggagttggaaagaaccaactcaactcctcccgtcgccgcttcctatgtctgggatcttgatcctggttgtgaaggttcaatgagataagcaacatgaaaggagttaggctggtgcctggcccccagtggcactcagtgaatagaggttcaattgagcaatgtcttccttgagcctccttttcctacggaattactaataatagatactatttactgagctttcaccatgtgccagtactgtggaaagagctatgtatgtgttatcctacttagtcctcaaaataatcattctatacacaggaaaactgaggcgtacacaagttaaattacttacccaaagccaatgacttgtacatgacaaaggtccatctgagtccaaatcttgaggcttcaccactatgctttctgccgctcctattttctggtcagagagaataaagtgaccttttctccggatcttttccagcctatgaacttcaagagtgcccagacccagagccctttgccaatggcattgtgaggggagctggctacaacgtgggacaatcagtgaccttcgagtgcctcccggggtatcaattgactggccaccctgtcctcacgtgtcaacatggcaccaaccggaactgggaccaccccctgcccaagtgtgaaggtatgtcgctccctcatccccagcagttcttcctggggtactcgtggagactggtccagagcaatcccatgttccacctacctgctctgtgggatctccagggctggaggtccaggcaaactgtggtccatcctgttttcacatggtgtggcccagcctctccagggagagggtcctggtgacagggctccgggccagcactagggaggacctggaggagatgtgggccacagccaagaggaagacacacccagcccttgggaagatccaccctgacagactggaggactcccattggaagggaaggctccatgtgagggagtgggagcccagtggtatgctgagagctagagaggtagagttaatccaggcacctgcccaaagggagaagagcatgaagcctctttataagaactctcttgctcccctcttcatcttccccctccctgctccattatactctccttctacacagggctggagagacctgagttgatctatcagggagctggaggtggcactttcttgggtcttcttccttacccagaaccaggaaggaaggtgaccaagagcttgtgctgcctccaccctcatctgcacacttcagttccatttgccttccctcttcattctggcatcccatcattttcctggaggagtggcagaaatttgtcttgaaaaaggaagccttagcaagggcagtaatccaggaaagagtgccccagctctaggatcagatcaccccaggctccaactcaaacccctttgcctctctaagcttcaggttcttcctcagtaaagtgggacttctcatctttatttcacaagagctggaggacttcacagatggctcactctcagactcaaactctcagtttaactctcgatggaaagaggaccttgtttgcgaaactgagccgttctggtgttggaatgtaaaaccatgatttctaaaactattatagcctcagttagtttttcagattttcagagctctgctctgcgtaaccagttggtcattccgcaattgttggcccatcacgtgctgtgcaacaagcctcatcctgggctttcttccattctcacaccttgtttgtctttttgtggcatcacaggagagagaaaagagcagcgctttctcagtctgctagcttgagccagaagctgttcttcctcctcagaagccttcttcccttggcttctctgacaccatactctcttgctttctcccatgtccctaatggcaaattttaagccccttaatatagcacacatgacccttaggttagggcctagtccctgctgacctcccatattctccagtcttgcagattttatgttccagcctaagctgaaatactttgttttccaatgtgccatgttttcttgcctctgggtcttagcatatgttgttcctttcccatacagcattcctctctcttaccttgcctacttaaccctagtcatcccttaggtctgagtataaatatgaattctagaaggagtcctttcttactctcacaaaaccagatgcagggctcccccaaacacccccgtggcattcatgatgatgacatggtccagcctgtgctacagatgctggtgtgtttggctgtgtcccagtggtgtgtgtgcctgggacagaactagagtaccttgttccccactgtctcccaggccatggctggcacccaggagatattcagcttatgtagcagggatggcgtgtacctgtgcaccactttcaggatgtacgtgcattcacaggacccctggcctctgcttggaatctgttgggattctctctcctcagtctggtctgccccaaccagatgtctgcttgatgccccatgtcagctacaacactcattattctggaccatggtgtttggggatttttgtccaccatccccatctattttcctccatggtgactgattctgaataccatgaagatgtcaaagtcttttcatcctcctgcctgaggcctaaatcagtgagactaaaattgagtattgcttttggggaacaggaagataaggagagaggatcttatctacatagcaaatgcgtcctcttccagggcctgggctgaacattttgcctgcatcgtttcacctcatcaccaccacaatcctatgggggaggtattcttagttccattttacaggtgaggaaatggagactcagggaggctaaactacttatctaagactatctgctcaatacatcgttcagctatgatttgaacccaaccttagcctcaccccaggaaccctcaactcgaagtctagaccacaagtaccactctagaaagagcagatcaaagaggaagaaagaaagactttcctaatttcttagctcttcccagcaaaagcactgcagctctgaccctaacgtctgctccctcccattcctgggaagggagaggggacagcttcagggcatcctttcttcttggcagttctcttcataagaaagagaaagagggaggctgaggcagacccacagaggggcctgcagtgatgattgagagccagccagggtgttctgtgtggggactggtgggtagaaccaggtgcagccatcctcagcttggcctccccttccgcatcccacccaacctccctgacaggatgattagttctgggagctgggatttcctcaggaaggcatctgaattctcaggtgggtaccgaggccctgcacttacgtttgtgttccctccctggcagtcccttgtggcgggaacatcacttcttccaacggcactgtgtactccccggggttccctagcccgtactccagctcccaggactgtgtctggctgatcaccgtgcccattggccatggcgtccgcctcaacctcagcctgctgcagacagagccctctggagatttcatcaccatctggtaggccaggtgccatgtcaacagccaattagaaaggagcattactggggttctacactgggttaccagtcagttacctattggtttagaaaaaccaagaggtgaatggtttttaaaggctgtcagcctcctgggtttcaaataaacatagtggaatggggctcagctccaactggccattatggctccttaaagggagaggaatgggagggcagtggctcccagcctgcaaccctgccagggccagggaaagtaccagtgggtgtgttaatgggagtaggtgtgggtacacagactttcctcggtatttccagagttcaaaccaacattctacatgtacctgggctaagccacccagactaatggaagagatttgaggtggaattttgtgatgtcccgttggtcatctggtgctgagccagcactttccagcagaactttctgcagtgatggaactgttctatgtctatgctgcccaatatggtagccactggctacagagtacttggatatgactgagggtctgatttttaaatgttatttaatcttgataatttaaatgtaaatagccatgtgtggctggcagtggctgaattggacagctcagctctgagttatgtagttatatacaacaagagttaattttacattgggaatacaaattagcatttgatatgtgcagtttcctggacagtttcttcccaaaccactggatctttggaagagcaaataattttaaaattcctttgtttggtggttactgccattctgagaatcatcggggttaggggaattctcttccaaaattcccagggcttggataactgtaaccagactgccctgggttaatttccagcatgatttccaagcaatggctaggaacagacaggaggggttagataaggtttcagggaagaaatcttttgtcccaaaaggcattgtgggtatactctttgcttggaagacaaggcaatggagcatggagccgatatgcatagcagcaggttttcacaccagctcctcagccctgtcctagtgctgccccagactgagaggacctgtggtaagacccacacccctgctccatggagcctaaatttgcccaggagcccattgggctggtgaagaatcaggtggatgaggaatcagtgtgagcttcaccaattctatcaactatgttgggagaccaagttgggaacggttgggagaggtatttagggcatggtgtggggaagtgttggtacaaaaagaatcatagcctcccactccaggtctgtcttaaggccactgatggcaccaagtggagcaggcagccatggtgactagtgacatgccaggaccttgtttcctgtgtacagggatgggccacagcaaacagcaccacggctcggcgtcttcacccggagcatggccaagaaaacagtgcagagttcatccaaccaggtcctgctcaagttccaccgtgatgcagccacaggggggatcttcgccatagctttctccggtcagtatggaagcctggcctggtgggaagggccaggctttcaagtcaaggctgagcttgactcccgtctccaccatttgcggatcatgtgaccttgagtgagttgtataacctcttggagcctcagtgtcttcagagttatgagaattaaatgtattagcctatgtgagagctctcagtgcagggttctgtaaatgcaagttttcctcctattccacactgccagggcagagaggcacagaagcccaaaccttggtgccaagtccactcattcacatcaactcactggctggatcatccctatacctgtgccccagcttatcccttagcactttctagcgggttctccttctccaaagggatctagggcttctgctgacctctcaaggagcactgtgtttttgtgcacaaatgaagatattgtgattttgagtaggaagagtatgaacaattcagagtaggtatgcctttattggcagcctgttttcttctacaagtcccaagttagggatctggatatttcctcatttttattatagtggaattgcctagagaaacttatagaatgttctctgtggacttgtgcctatctatggaatgatgcacatatttgcaatttacagatcactgcagatattttaaccagaaatcaggaaagctggattttactcccagctccaccttgggccagctgtgtaaaaccttgcacaggtcccttccccacttgagacttcagtttcttcacctgtagaattaccggcttggagtttgtgacctgtaagaattctgtgaggtagtaaggcaaatattctaacccccactttacaaatgaagaaatagggcaaaggaaggctcaagtacttgcccaaaaccatgtggatagaactggaaacagaacccagcctccgcagtatctgctgcagtatctgctacagtatctgctctggtgtgactatacagtgttattacatcatgcgtgcacttgcagaaacacactaagactgtgaaagaggtagtgaaagaaacaggaagcaacagagagaaacaaggatgtaaagaacctaagcagctgtgactgccattcccaggagctatcgtccagggtgagtgcaatgtgggaatgagactccgccctctccatctgctcagttcccatgcccctctcattgggcacacctgtcgctccactaatgaaatccaggctttaaggctctgtcattttgacttgtgactttcccatagagtgataagagtatggacttcagagtcacagacgggttcaaaccttggctctgacacatgcaagctatgtaactttgtctgtcatttcacccttctgagcctcaatgttattatgcacaaaataggaatcatataagtacctaacctcctaaagttaaatgaaacaatgcttggaaatccttagctccaggcacagagtataaaaggtgatcaataaattatagttctaatagtcatcattgtcatgattatttttattatatctagatattgacaggcttggtgtaaagttaccttggtggtaggccaggtctcttgttcctgttcctgagccttcacctgtaccagaaccaggcaaaggaggctcagcacagccccaggccatccttatttccaagttcttctcagcaaggtctttcattgagagtgcttgcctaagggcacaatgctccttctgcctctcagatgagacacaaggcccttgctatggtgtaaatgcttaggcccccctagaattcatatgctgacatcctaacccccaaggtgatggtattaggaggtggggccttgggaggcaattaggtcagacaacagagccctcatgaatgggattagtgcctttataaaagagacccacagaatcaccacactgaagccttctcagtggaaagagctaagaagcacaggaaacacagaggccgaggtgggcggatcgcctgaggtgaggagttcaagaccagcctgaccaacatggagaaaccctgtctctactaaaaatacaaaattagatgggcgtggtggcgcatgcctgtaatcccagctactcaggaggctgaggcagaagaatcggttgaacctgggaggcggaggttgcagtgagccaagatcacgccattgcactccagcctgggcaacaagtgtgaaactccatctcaaaaaaaaaaaaaaaaaaaaaaacacaggaaactcatttgctgcttttaccacatgaggacacagcataaagacagctgtccatgaaccagtaagaaggcccataccagacatcaaaattgccagtcccttgaacttggacttcccagcctctagaactgtgataaataaatttctgttgtttagaagtcacccagtctatggtaatttgttacagcagcctgaatggattaagacagccattcagtcccagctcagaccagagcccaaggcttcactgaccacaggagcaggcaagggtctggggcaagagaggaggaactgctgtgcccagatcggcaggctcaagtgggagaggcactggactaggggatgagtgagcaagagaggcacattccatgcctcatagaacttttggtaagttgtggaatatatcctacatataaaaatgtatgtaacatgtatgtgcagtttaaagagtaataaaatgaacaccatcattgagcctaagaaaaagaacacctaagcctttgaagctctgttccttcctcagcacattcccctaccctaccctgagagttaaccatgatcctgtacttttggttaatattcattgcttttctttttattttactccatatgtgagtctccaaaaatatgttgtttaattttgcatgttatttctgttatgtaaagacaatcattctataaatgttcttctgtgacctgctcttctcactcaaaattaagtttttgaaattcatgttgatgcacgtgactgcacttaactcatttttcaatgctgtatgatttcattgcatgaaaatatagcaatttatttagtctactgttaacacttaagttgtttcatttcaagcaataagaacattgttgcttattccttattgtgaacatgtacaagggtttctcttgagtacatgtctgtgtggagttgtgaggttgtaaatatccacatatttagtttcactaggtaatgctcaatttatcttagaagcagttataaccatttacactcttcccagcaactgaagtagagttccttttgctgtacatccttgcaaacactgggttttagcagactttacatttctaccagtctggtaggtgcatgagatggcatttcacttgtatgcttgtgatgaggcagagcatcctttcctgtgttactgagtgttcatgcttcctgctctgtgaaatgtctgctccccagacagctttcctgctccaaggagaaagagataatgagtaaccaagaggacaaaatttttgcaaattgtaacaaatgcttcgaaagacataaaaggataagatagcaaacaaaaagttgtagaattccatgcaaagtaattgtggaaaacctaagagaggatattcaagataagaactaaagaaaaaaaaaggagctagacttgcaaaaagtggacagtggaagggagtgggggaaagaatttttgcctttctccaggcaagcagccctaaggaactttcttttcatatgaggatcaataagaaaaaggaaaaataccttaaggagacctgtgaaagattttataacattaaaagttagaacatgaagtttgaattacagagaaaaatgcccttgaaaaaaaaacatggtttaggaactagaagtaatagaaataaattttgggaagcatcttcttctaatataagtctagataacatggactccaaataacaggtgaaatgttcagacagcacacaaatgaaaagaaagatctggccaagagataaataaaacgaaagctaaatctcttcccttccccacttgaataattcagtcctaaagctgtgagatgggacaaagcaaagacatctgatatggtttggctgtgtccccacccaaatctcatcttgaattgtagttcccataatccccatatgtcatgggagggaccaggtggagataattgaatcatgggggccagtttcctccatcctgttctcatgatagtgagttagttctcacgagatctggtggttttataaggggcttccctcttcactgggctctcattcttctccttcttgctgccatgtgaagaaagacgtgtttgcttccccttctcccatgattgtaaatttcctaaggcctccccagccatgctgaactgtgagtcaactaaacctctttcctttataaaatacccaatctcaggtatgtttttattagcagtgtgagaacagactaatacagcatccatacctgtcaggcaagagggagtgtgaaccattgtagcccaggccggggtgtcagggggagccacactgatgggctgcctggcatgggcagctggagcttaggtatctgtacagggatggagctggcacagggtgtcagagctctgcgcaggatgagcagacacccatgtagggtattggagcccaagcagaggaaggcggacagccacacagagaaggttcagcccaggaaaggaagtcagagcccaagtagggtgaggagggaggggtcagcagaaatgaaaccttggttccagatgggtgactgatcgaatacgttaatacgtcaaggacaatagaaggcaggtgtctcactgtcagagaagagggttagaactatggatagagcaaaaattataatatacccaatggtgttaaatttgaattggatgtatcagtgtgagcttatggttttcaatatgtagagatatggaagaaaatagtgtgtgagtggggcatgtttgagtacatgtgtgtttgcacatacatttcttagctctttctactgagaaggcttcagagcagtgattcttcaatagtaatgagcacatctagcaccagatattggttcctaaataacattttccactaaaatggaccagggctccttgaagaaatggctaatcccaagcctggggcagagaaagtagaagacaagccaggaatatcttatggcagaaactaaggaaatgcccaaggcatgatggagacatgtcaaagggacatagaatctggcttggaggggttctcattgaccatattggggataatttgagaatcaaagttgtttaaaatagtaacaaatggtggtgacctattgaatcaaacagaacactatgtatatccacgcagacattaaataattacaagtttttataaggaaggggatatttacataacttcaaactaccccttcccccaccccactccacacacaataataacaaagggaaaaagaagtggagaagactggaagacacgcccacctcatcaataatgggacaaattgaaatcatactccaggtgagaggatgcagtgagaagaagccagcatcacttccatgattatccagttgcagaagacaagctgaacataatcaggaggaaacaccaggcaaacctaacttgagggacggactgtcaactccctggcaggcagtcttcaaaaatataaaagttctgaaggtcaagtaaagacactggaaccattccagactaaaggagaccaaagagacatgacaatgaaatgcaacatgtgattctgaactggatcaataaattatcaaggaatttatcggaaaaacaggtgaaacttgaatgagatgtgaagattcgatggcagtaatgtgtcagtgttaatttcccaatgttgatggttgttttgtggttatgtgagagaatgtgctagtttgtaggaaatacactaagatattctggggttacagggcaacatgttggcgacttacttgcaaacggttcatggaaaaagatttttgtactatacttccaacttctcctatacctttgtggctgctccaaattaaaacttttatttccaagggaagctagatactaaaaaatagcaagactgaaaagaaacaaaatagcgtaattttcatcatcacaagaatcagcgagagcagaagcaacactgtagaaaaacaatgcaaagatgaggaggacaaacctgaaaatctcaacccaaatagggagaagggcagaggcgtgaaaatggtagagagaagatagaagataagaaataaggagacccagtggacaaagagccaagacactgataacaagcattcaggaagaaaggaaccaaatggaaatgataaaacttttctgagatgaaagaaaacctgtgtatataaaggagctctctggataccaagagaaataaaaaagaggctggcaattttttcaacttgtaagggtgaggagtaggggaaatctacaagaatccaggctgagaaagttaccttaaatgaaccaaaatcagacaattctcaggctaatttttgacgttagattacagaaaatgaaggaggtgatgtttaaggaggagaaaaagttaggggcttcatgtgtgaatgcaagaaattgttatttgcagggattcaagaatttacaattattgccactctatctcaagcggggctgtaactccaggtggctgtaactccggatgaactccagatgaaccagtaactcaaaatagagaagatgtatgaaagaaaagataaaaatggagtgttgatactagttaagcacagacttaaagctaaataataatggaacatatggattcaaagcagtgcaaatacaataattcttaaaagactacaaataattattttatattaataaatgtgcaagaaggtggaaaagggataagagaatgtccttatcttttgtgacggtggaatcaatatatattatccaattgttgactttgatcactagagaaataaggattttgaacatatactttagtcactaatatatttaaaataaagtatagtacttctaaatcactaaaagaaaaaacatgtaaaacataatccaaatataaaaggcagagaacaaaggaaactatgtagggacaaagatacagcaagcacaaaataagatacagcagtagaataaaatcattcaattgtaatgaaaaatgcaaatttactaaaattcaatttcctgttaaaaaacaaagactcttaatgatctggtttggctgtatctccacccaaatctcatcttgaattgtaactcccacaattcccatgttgtgggaagaacctgaattatgggggtgggtctttcctgtgctagtctcatgatagtcagtaagtctcacaagatctgatggttttaaaaaatgggagtttccctgcacaagctctgtcttgtcttgtctgccaccatgtgagacatgcctttcaacttccaccatgattatgaggcctccccagccacgtggaattgtaagtccaataaacctctttcttttgtaaattgcccagtctcaggtttgtttttatcagcagcatgaaaatggactaatatatttagattaacctaaataacattcaactatattttctataccaggaacataactaagacaatgtgacacagtttaaagataaaagggtggccagagattatattgggcaaacataaacaacaacagtaacaatcaaagaaaaatgcagaattcataatgtcttcaaggttccatgttatagcatgtgtcagagtttccttcctttttaaggctgaataacattccacacatgtggtatatatttattaataacgttagtacagaccacattttgtttatctgttcatccctctatggacatttgtgtggcttctaccttttagcttttgtgaataatgctgctaagatcatgagtgtacacatatgtcatgataattttttttttttttttgagacagagtcttgctctgttgcccaggctggagtgcagtggcgtgatcttggttcactgcaagctccgcctcccaggttggcaccattctcctgcctcagcctcccgagtagctgggactacaggcacccaccacctcgcccagctaattttttgtacattcagtagagacggggtttcaccgtgttagccaggatggtctcgatatcctgaccttgtgatccgcccacctcggcctccaaaactgctgggattataggtgtgagccaccgcgcccggccgtcatgataatttttaaagtgattatccaattaggaaggttgcagaaagatgcccacttagtgataggtagtttgagaattgcagatccaaaaccttaacacaatatgattagctacacattccaatcactttgtggtgcctgtgccactcataatgttctctttaactgctcctcagggcacttggcagctgtttgtacattgtgacacccctccacgcacacatctgccccccagccacagaagcttggaccagaggtggacacctgagctgactgcagcaggggcaatcagatgttctctcttgggaagttgaaataggacccaagagattctacttttgcctggacccatctcctgaaaagataaaaatccaagtgcaatggattgctgctcttctactttccatgtggaccaaaaagtagaacaatcctatgtgcagaaagagaatgattgagaagtggaaaaatttccttggtttctgatggcccttcagttcctcgtcctctacctttgtgaagtctggctgcaaacccacccttgggttctctcttctctgagaggcttttttgcttattctagcctgaattgatttatttacatccaaaggttcccaaggaatacaacaacctaggacccagcaatcctacttctgggaattatgcaaagatatgtgcatgaagatattgcttgatatgttataacagggaaattagaaataatctaaatgtaaaaatagtaagagattaggtattataaatttaaagtgtatactcagagagagagagatagggaaagatacagtcattacaaatcattcatgtatgaacctgggcaacatagtgagactctgcctctacc

SEQ ID NO: 25 - DNA, 104703 bp, Homo sapiens
cccctttctccccctcggttaagtccctccccctcgccattcaaaagggctggctcggcactggctccttgcagtcggcgaactgtcggggcgggaggagccgtgagcagtagctgcactcagctgcccgcgcggcaaagaggaaggcaagccaaacagagtgcgcagagtggcagtgccagcggcgacacaggcagcacaggcagcccgggctgcctgaatagcctcagaaacaacctcagcgactccggctgctctgcggactgcgagctgtggcggtagagcccgctacagcagtcgcagtctccgtggagcgggcggaagccttttttctccctttcgtttacctcttcattctactctaaaggcatcgttattaggtaagtaaccggactgggtacctgtacagggtgctgtcagggaggcgtgaggtccacacttagtgcgcggacactgcccgctgcctgcccctgaggtctgaactatgacaacggggtggttttaaagacgcttctgctattctcccttcccccttctcttcccgggaggtaagagaaagagcaaaccccggaggtgagcgcagggagaatatctttttgcactaccaccgctgcgcttggttactttgggaaaactctcacttttgtcagaaatgtgtcggcgcatgaatttccccgacattggctgtgcaaaaaggtctctccctttaatgggtacagccagcttcagcgaggctgagggaaactctaagattggggcgggtgttgacaaaagagcacgtcccggactcccagactcgcccggctgagagattggagctgaggggcgatgcctctagctgagaaactacccctggcctccctgcgctcctctgggggctcgggtttggatccctgccaggctggctccaacccttgagggtacgacccttggcgcagagaggagagccaggagagccaggagcgcacagggttcccggtgctgtttctcttggcgctcgcctccccgcccttccttcccgccctatttttatggggctgtactcagccagcacctgctggatgtggagatggtaggtgtgagaaatactgcctattttttaaaaatcaacttataatctagccgaaaaacggcatcattttctcatttaaaaaaaatgacttttctaagagtattgccagacataaaagggttcctctttctctaaagaaatgacttgtaatcccttagccaaataaataaatcaataaaccgcccacctatcccataaataggtggtgttttctaagacagaacccagaaacagttcacgtcctcacaaaggaattctttttcttaaagcgcgtagcgataaaacggctcttttttttcgagaaaagtaatgtaccttttaaaagaggttcatcggaaaatgtgactttttaaaagcgagcagccgcaaacgggtgtattttttagactttagaagagcggagcggcagtccgcccgggttgcggctgggactcgcatctgagcgcttagtcgcaaaaggactgaggggtaggaggagaggtcactttctcagagtgtatagccagagccgcttccttgcctctcccagggaaagacttttagagcttaaccgaagatgggcccttttgcttcagaatgatttattccgcgttcctctgcttcacccgcctgcggcttagggtgtggggcgctaggctgctcatgtgaagcgcttacgggtgagccctagcctctccgatgcaaaatgtgggctgggggctgggaattgctatttgcgccactgcggcacacacccacaaagcaaaaaccgtggggaagaggggctaggacaaaagaaaaagaattaaagctcagcaacaaacaaaataaaaatttttaaagtgtccttttcttgtgtggaaacatcacaaaatgggatttaaacccagcctaggatctgtttgtacgaagaaaagtgtgtggaagaaactggttgaaaatccgggtagaagggggagggggggcagcaaagatggggaggaggcgatggtgtcatagcagtcgcctgtgcgctcttagcgctgcaaccaggaaacaacctgaggagcatgcagagaattccgaacgctgagcacacctgagaacatagaggtgctttgtgacttaaagcgacctaggccccctaaaaagtaaaacaggtgtgactcaaaatagaaaaggaaacggtacttgcgggcacccgcgcaacttggtaaagactgacggaattccacttttaatcttgtttgaaacaaactctcgcaatcccagcaggaaattccagcgccagggctggcctttcctctgtgggtctgtgtgtgtgtgtgtgcgcgtgtgtgtgtgtgtgtgtcgcggcggggctgggggtggggaagcaattcgaagcaagtcgaagtaatagtgtatgtacacgtttccccctttcttgcctttgtctggttcatcatagagagagcgcggaccgtgtgcgggcggtcttgacgaaagaaccgagagatggatgcgctaaggtctaaagatacctttctccctcgactaaattaagaattgccgcgacagttcccaaaagctgagtcccgctgcagctgccaggtcgccacactcgccaagcggcgagggagcgcctttgcctaccaggccggagaaccctgttcttcagtcgccttggcaggggcagcccctccttctggcaatgatgtcagctgcagagaggcttggcccggccgatgggaagccgagcggcgagtccgacccgcaagcacgagcagccctgccccgcgcgctccctgcgcgcagccgccctcgtgtcccttcggcctctcctgggtcccggctcgcagccccccccttccagtccctcgctcctcagaggcgcgctaaggcgccagaggcgggggtggccactgctggcggcccgccgccggttttaaacccggggttcaaacccagatttggggtcttccctcctccatttcctcctttcctccgcgccccagctctctccctttttcagcctgcaccttcactattcacagtgactttacttatttagcaacattttagagggcaagtgttccagatgcaataatagtagtaactggtgttaaatttctgctgttttctctcccctcgggtgataaaaaagatgtgaagaacggcctctttaaaaaaaaaccccgtggctgctgcttcgcctgtcacagagcaagctctctagaaggcggggagggtcatctttcccacaaaattgtgaggtgggggagggtttgtaaccttaggcgaaagcgcaggctggggaatccccttcacagaaagaagaaactgcaaattggaagttgcggaaaggctctatccactactgccataggggagagaccaccatgctctttatttagagacacgcgctccaaattgggatgatgcaggaataggtttctttaagacggaagcccgctgcggcttcccttttgagcttgctcttatagtcctaaggagcaagcccctgctttgccaaatttgaggctaatctgttttcctgattgcggacaattccttctttagctttggtagaagggccgcagaatgcagttggagaaggttgcacagggcaagagggaggggcagaggcagggcgtgtagaggcaactggcgcctggagcagaattaccttccaaaggaaaaaaccttcaaggggtgtcgcaacaaactgcttacttactgtgttttggtttggacgcaggtgagagatgtgggcaaagggagcagaagcaaagaattactctgttttgtaaaggtaggattcttcccccttccttttcttcttccctttgatgaaaagcttccctttcatgacgtatagctggcagcaaacttaaagttgctgtgcgtctgaaatacaggaatgggaaagaaactccgaccaagcataaaacacactcattttctagagctcagtcatttgctaagggttgaaataaactgtgcacccccactccctgccccttccccctggctccttggcctttttgtcaccggactggattctgaaggacgtccaggtaatgctgggtttcagcagctgaaagccctggcagaagggattgcaggtttcacattcttccttctcttggtattcaaaactttatttttttttttgcgagatagaaattcttgatagagagcttccagactgctggtggcagggaagaaatctggttaagagattcagaaagcagaaaattctttttctctgcgcaagcagtccacaacagcatttagctaggatttataagattcttggtggagcaaggggaggcacatcgacaaaggagagtttatataagccactggctttgagctacattgaaaaaatatgtatggcagccacgttttcttagtgggaaagaaaattattcagggaatgaaattttgaaggctaattctctccaagaatcttgcttcacataatttaaaggaggtgtcatccctgtatttgttcactgaagagtccacgaactttaattagtcacctactgtgccagacaatgtgataaatggtgtaattgaacataatggagagaggaattaatttttgttaagaggttgagaagaggttcataaaggagagagaggtctgtggctttaaaaatagtcattcctagtcagtggctagccaagaaatgtatctggaaggtcatgccctgtacagaataagtaaggaagggcatgagggcttgatgtcttgttacaaagtttagaggtatatgtgtgttttgtagacctagaacatctttgaatatttttttccagcaaattcgttaaagtaacaacaacaaaatagcctgagaaaattgggcaatagatagcacacagtagaaatattattgttgtttgcatttaaatgaagaattgaatacattgatgtattacagtagagagtggaagcaaatatgttaagaagataatgtaacatccagaaaagaggactaatgaaagaatagggcctaaagctaatcagtataactaagaaagaaaagaaggctactttggggaataaaatttctctttaggcatcatcatctatccactcagatctttttactcatctcagtttccccatccagccttcgaaaaattccccatcttccatctatcgagtaaactccgtttgtcctggggagacccccactccttcagccactttcaagcacattcatcttcacctcaccccattttctacacacatccctgcatcatctctgaaccttacatcatgtaacattttacccacttcagccttctttctacaaccagttagagcctcttaatcttgtctttttcctccctttaggcactaacaaatagctctatctcgcttctttttcctcctctaagtcagctattccccgcccctttcccatgcattaattatcctgctaatttgtccactcatttcccccttttacatcctcctccccattagccaccttgcattctcctatctttcattgacctcaaagaagctaaggggaaagaaaagccactctactttaaacttgcttagatttgccaaattttcgtcatcaaggtttcttcctttctgtgtcttttgctgttttagttcacacaagacttttagtggaattccttcaatttgttatatatttttattatgcctgcaaatgtctgttttcctttggttgtggctggggattcaaatattttactttggggagtatttccaacctttctgaagttctcactgacacactcctgacactgtttcgctgcatcccatcctttctgctgtattctcttcccatgggtaattccttttatattttcagtgaaattctttcttatttttattccctcctccccccctcctcctttttttctttttgctttgtgggattggtatagcggctcaagtttaaatattttgagaagggacccccctcagcagaccccctcatcccacacacaggattttaaagcctgtgtcaacgtgtgttcatgtcaacatacagttaccaatcttcagaggcaaaggaacccctgtttgttttattttaactgcactcttagaaaattctttttctgtgtgtatggtaaaggtgcaattctcatatcgttcttctctctacattcagtggaattgattcaacatcgctgggaattgggaagggaagaaagagtacgctgtaaaaatacatttttcatcaaagacatatatacatattacctttgggaaaaataaaatactttggaacatttaattggattggctttatatgacaacattccaaattacatgtcattgtctgagcagagttctattatttgaagactttattgatcattcagtgtccagaatgaagaaaactaggtaagatgtcttgatgttccaaactggcttgctatgttcaaattggtcatatttgaaatggtgttatttttcaatagaagttcttcacgaaggcatcatctctaaaatgtggttatcttttgttaggagaaaacatcaaatgacctatgtgtcatggtcccttaagatttattctctatgcaaggttaattgtaaaataaaagtttatcagatagagaaaactattttagggtgaaactgtcttttgatcttcagttacatctggagaaacactgcattctcattatcaaacagcaccaaaacatgggaaaaagagtatttttcaattactgttttgaatttgaggagtagcttgccagaaattatagatgtacctgttatctttttgcaatctaaaaatcctcaactgttcaaggatttaaactgcccttttaattgtctctaatgtgttatgcactggattaatataatacattttaagacaaagaacatcagtggctacaatttttgtttccagcccaaatctgaaagaatgatttttgtacacctaatctgctcatcttgaacgtgtagatttgggtaaataggaggaaagataaatgaaaggagagaataaattccggaagaatatatttctctgttcaataaaaactgttttaataatctaatataacttttagcatgacaatgataaaattaatttgctgatggattttaattaaactaaaggaaaattcatttcttttaaaaatccttaagtgattagagtgcaaattgagattttagctaattatataattcagttactatcatcacataaaatgaaattaaaagattgttttctgtcacctttattttgattcattctttaactccttcaatatgtatagtattttatatttttatatcatttaaaaagttatattaggatcataaaaattttttgagtagaaaaagaaggcatggttatacccattttgtcaatggggagactgaagttcccgctgatgaaatcagctccctaagaatttccagaattaagaggggaagcttcaagaggattgatggtctttagtctccaagccaggtcttttcccaacatcccttcttgcctctcttttatctttgagtatatgttgtcaaagttctgaatgtaaaaagcaaaaatatataatgtgtcttggattaaaaaataaaaatttcaaagacaagtatattcaaatatattaaaataactttttcagttaattttctactagcattatattctcctatttagtgtctttttgcactaagctttgtaaacattatatgatattaaataaaatggtagaactattgaaatgttaacagtacatgcttatatgcttcttccattttgtttacaaaaataatttaaattatgacccatcataatgacagtccctaaagtttgagtttacttaatgtagcaaatgtttagtcctatatcctactatcctactgtcatttttttagaacacctgtatttttacataagatttattttaggggatgtttgccaatgatttttaggtagtgttttttttcctgacacgacattttggaagcaacatatctttgataatcagttgagtgtgggtttgtatcatatcaaccgaaaggatattaagcccccaaaattcaaatcattgtttgttgtcttcagattacaaactcgtttcaggtacagtgagagcaggggtttatttaaattgtgtgaacacaaggtcttttatgatttatgttttattagtgtctagagagtgaccttgggcaaaaaccttcacctccctggacttcaatttccccaaaagtaaaatgaaggaattgtaagttatttcaaggccctttgcaaagggaaaaaaaatcctgtgatattttacaaaaagcagtagacgtctaggacattctttccttgtcccttggctctgcacgtattatcaatttgactgtattgattcattaaccatcaataactaaaaacctatggcttgtccagcattgcaatactttaaatgttaagggtggcccttaaagaaattttggagagttctgtctttgaaaagcttatattctaatagggctaaaacaatgaacaacaacaacaacaaagtaatatatagtcacattaaattgaattcaacaaatattcgttgtcactctacattacagtacaccaagtatagtgcaggttttatagactctgagagtggaagggaccagaaagataatttagtccaaacccttcattttacagataagaaaaggaaggctcagggatgagatatgagtgctacaggagttcatgtaaggtattgggtgatagcatgaattaatttattccacaaacatacttgttccctgctttccaatgtgtttagaattttaaaacaccatcatgtagggctttttaattacctttgctcaaatttaataatagtatcttatcagaaagttaaatgtatccaaaacttgtttgttttttgttgcagtaaacaatttcccactctgactcagatctagaaaatactgtttcccacattttgtattgaatagagattattaaaagcacctgtattgtgcatattatgttataaaacataaaaagtgatgttttgatatggaaaacaagtgaatggattcaagtatcaatgcattaagtattttattttttttaaaaaatgactggaaaagcccatttacttaaaatggctagaaatatacattcctggaaggatggttttatttttataaatgcatatttactctaaatagttaagtacacatttcctttaagttttaaatataatctggggaagattttgagtgcattctctaaaatttgatgattgctacataatctcattctctatgccagggcatatgtgcgtttgttagggagtatgggtcaggcaaaggtaggcaggaaaattatgccaaagcaaagctttcccttctttcctgagtaatcgtagactgctttattttactttgtgacagaggaagaggggaggagaaaggaaatcaaatagagaagaaagagaactaccagagcgttggatgatagggcctgattttctcttcagtgtgaaatatgcaagctttttgaaactgccttggatagcttctctcttttacttctcatattatatatttagaataccttaagtgttggctggtcgcagcggctcacgcctgtaatcccagcactttgggaggctgaggcgggcagatcacgaggtcaagagatcgaggccatcgtggccaacatggtgaaaccccgtctctactaaaaaaaattacaaaaattagctgggcgtcttgctgcgcgcctgtactcccagctactcgggaggctgaggcaggagaatcccttgaacccgcgaggcggagattgcagtgagccgagatcgcgccactacactccagcctggcaacagagcaggactccgtctcaaaaaaaaaaaaaaaaaaaaaaagaaaagaaaaagaaaaagaaaaaagaataccttaattgttatttgatggttgtttgctaggttgtgagaatcaaaatcttccaaaacatgaatacattaaatttttttaaagagaggcttaagaataggtaatacacacaccaaacacacaaacaggacaaaacctttacatgagagctcctcaggcagaatttcctttgcctttctttttagatcgggaaagaatttgctcagtttgtcagtgacgttttacccttcagtctgcctccacagttcttaaagctttccttgtctgcagcctttcttagtccatgaattcagttttagcatccataaaataaagcagttacaatatgtgctggccattttataatggccatgagtgcaaagcaggattacttaagaaagagcatttgaattcactgaaagtcacagacattctgaatgcctcagaactgcatacaggagtaaacagatatgggaatataaggctaatgttcaaaaattggatagctggcatatataacagaatcaaaacactttagaaagaaatagaaccaatatacaattactaatcaatcagcatcactgctaacgacttgttattttaaactccagtttctaggaaattacattctattcctgtgcttctcaaactataatgtgcagacagatcatctagaaatgttaaaatgcagattctgattcagtagattctaggtgaggctgaaattctgcatttctaacaagctccctgtacacatggaagctgctgcccctcaaactacagttatccaaaaggcgctgatccatagtctggtaaacaagcatgataaagatgaagtaagccaagggtaacaggatttcttaaaagaaaaaagaaacaatttaggtatgtgcaatggatgaaagttttaaattcaactagatttacaattatttgcatttagaggttaaatttgattttaaccttttgtgtgactatattggttgaaactgtagttcagaataacaaccagttgcttgtccattttgcagtcaaatctatttcatggacagtttgtacatacgattataccatttcaaaaatgaaaaccattcatcatacagtgtcaacggtgtaccagtatcttaaaatctttttaaagaaatccaaaagttctgagaagtcttagtatagtatagacccctaaagatattggtttgtaaaatatcagaattgaacatatcagctaatcattcagattttagagtagaatatccaattagattttcatttacctaatttgaaaaacttctttttattttcttattagtacacacattttgcagaacaacaacagcaacaacgaaagacacttggtagagattattttgtatttgctgtctcaaaataaaagtcctcaaagtgggaacaaatggtaaattagacaccatgctaaccactttcctcacaactagacttttatcttagaatacagccgaatagtcacttaatctaagtgaaactttcattcattattagtttaggaaaactttcatagttctcatttctttatgtgcagctcagaaacagtatcaagttaaaacaaatgacattgaaagcaaccattgaaataagtgtaaatgtttaaattgtgcttgctaggagacacggtatagttctagcagggttaggaaaacaactgaaagttttcacttcagcgttggaattcatgtcttaattgtaccattgagattcagaagccatcaccttcccgatgaaactgtactagtcttttctaagctctgatacttacaggaacagcaaagtctgtttagtggtaataatttgaggatctcagtgagataaagggccaattggattaaaatgttcttgtaagtgctaaatgaacttgagtgtctgccaaaattgccttggatttcattactcttaacattacttaataatgttaagctagtgcccatgtgggtatgaaccccaatcttgctaacagttttctgtattggtctgttcttgcattgctataaagaactacctgagactgggtaatttataaagaaaaaaggtttaactgactcacagttctacaggctgtataggaagcatggctaggggaggcctcaggaaacttacaatcatggcagaaggctaagaggaaggagtcacgtcttatatggccaaagcaggaggaagacggagcaggtgcaggtgccacacacttttaaacaaccagaactcgtgagaactcactcactatcacaagaacagcaaggggaaaatccacccccatgatcctatcaccttccaccaggcccctccttcaacactggggattaaaactggacatgagatttgggtagggacccgaatccaaaccataccatttaagcatagactgtttccatgtacctaatggggcacgtatagcagccaaaataccctatatctttttagggtttttttttttttgagagggaaaatccaaaatatacaaaaaggaaaagaaatataagaatcaagacaaaataaacagatagcaaaacatcttcatactctattatcaaagaatagagaagaaaacttactctatggtaaatagaaatatcagttctatgaacacgatcagtacattttttttttttttttttttttgagacggagtctcgctctgtcgcccaggctggagtgcagtggcgcaatctcggctcactgcaagctccgcctcccgggttcacgccattctcctgcctcagcctcccgagtagctgggactacaggcgcccgccaccgcgcctggctaactttttgtatttttagtagagagggggtttcaccgtgttctcgatctcctgacctcgtgatccgcccacctcggcctcccaaagtactgggattacaggcgtgagccaccgcgcccggcctcatgttttaagacaatgagaaacaattgagttaatttacaatggcattaaaataaaaaatcatatgtaattaaatacatgtcaaaaatcagactatctcagactcataactggaaaaaatatgaaataatttcttggcctgatccagcaaatattagaatggttcaaaatattaaacaaaataatgatgtcagagtattccaattcagtttcataactttaagtcatttatatttccagcttcagaatcaatttgagtagatcttagaatgagtttaattacaggaaaatattacataactggatgaaattttaatcataaatcacagacttgaagaatagattttaaagagatggcagtgaaggttgagcaatattagccagaagacaatactgtataatacatactaaatgtctaagtacttaaagtacttacaattgctaataatatgataggatcacaaaagaattagtaagaactttaaaggaaatggattaattatattcattagaaaaaaaattacaattctaagttacaattaggttccaggataaggactgacaactcaaataagcatcatgattcagagaaatggaagacactttgagaacatgatatacagtatttcctttacaatatcattacactttatatatttttatatcctatgccaatgatagcaactattagatcgaagcaaaaataattgtgggttttcccattaatagatcacccaagaacatgctttggttgtaactgaaactactaagtttttgaaacaggtaaactaaaaatcaaagcagatttatcatgaaacttaacacaaaaactaaacaaaatactggaaatagcactttgcagtaactactaaaagcaatatcactaatatcacagattttactatgtaaataattacattatcacttttaaattgctttcattgcattttagggtactctggcagattttttttcatctgaatctcacaacagttctgtgaaacaggtattgcatatattatatatttttaacatatgaggaaagaggcaagacaagtttttctattcttaaaatcacataccttttaggtgtcagagacaataatagatccttgttcttatccctggaataatatttgttttatcagctaatatatgcaccaatttattaggttcaaatataattaaggatatatattaaataacaatttagaatatattatatttacttttttaggagttttaaatttgtactacaaagtttcagtgagcactttttgaatcttattcggcaaaactattgtaatatccctggctttagtaatttaaaacatgtattaacataactatacaattatacagtagtcaatagtggactaggaaataaggatgttatcagattgaacaagaaaggaatactaagttggaaaacaaaattaggatttggttctattttcaaataatttcggaaaccagagtcaaacttcaagggattgtcttctctgtgaagataaaaatatttgaaataataggtctagagggagagtatttgggagcaaaaaggaaaattatggctatgggttggcttagatatagactgttaataatacactaaggtgtattactctggctaagtactggtaatgcttgatcacagaactttggtaggtttcaagtttctaattttatttgaattacattcaagcatttccgtaatagagttctgtaatagtagttaaccatgtggggtgaatagttttatccactgagctcatactttgttttccattggaagaactagattattagaaactgttacaaaaatatattttgctgttagagaagcaaaccctgtttagtttctttagtgaataccatgagttaattagtagacttaaaaatataaatgatgacacatattgtgctgaagtgccactgaatataagaaaaacactatcctttttgtaaagtttccttaaaactacagttctacataaaggtgatatttattcgtgaatgttttcttgaaagaagcctttacatataaccatttaacacttcaaacaaccctgtggattagctggagcagacatttttagcctccctttcttttgtccatttctgtttttcaaatgaagaattgagctagtccagattagctaaatggcttgcctaaagtcatcgtcaatttagttaggagtaacttaagattccatgagcttttcaccattgccatgtagactgagttactggtggtagataatttaacctaggaattatgtagtgatttgagatttttaataaaggaaggaaaagaaaggaaatgtttctcagatatagaatctaggttagggataacatttctttgcagaaaaaaatacaaattgtgatgagatattcagattctactgaattagcaatacactgaggtaaatcatgactagcaatgttttgatgaaaatatacttgtttgctgttggggtattcattctgttctcattattagtggctccaaatgaagaaagtaggaattattgtagtgaaatgcatgtccctaggcattctataataacctggaatttctagtttatttgattttcctgtttttacttaggaaggtgatatggtttggctctgtgtccccacccaaatctcagcttgtagctcctataattcccacgtgttgtgggagggacctggttggggatgattgaatcataggggcgggtttttctgtgctgttctcatgatagtgaatgggtctcatgatatctgatggttttaaaaatgggagtttctctgcacaacctctttctttgcctgctgccatctatataagatgtgactggctcctccttgccatctgccatgattgtgaggcttccccagctacgtggaactgtgagttctccattaaacctctttcctttgtaaattgcccagtcttgggtatatctttatcagcaatgtgaaaacagactaatacagaaggtcatttctgatatttttttgtctttgtgcataacttgtgcttttttggaagtaacttaaaacacaaatactgtttaactatgagctatgaacagttacacctactgacttaacgtgtgttttccagaaggttccattccctttgaagtgacttgcccaaggtcacaaaagcaacttagtggcagtctgaaatggaatttaggtctgcttggtcagtgtgcttttcactatattgtcctgtcacatctttcaccacagtaaaagggcttatgtacatttttttaaatcacatgtataatgatcatatagcccaaaatagtccagtgttaaaactagttttggttatagatttgaatggtaaataccaaactaatgtgtgttaaatagtaaaatggtgactctttttcaacaaattaaagacataaaaatactaactcattaactaattttctgaatgaaacttaaattttataaagcaatgttacatatgttataacatttaccttcttgaatgttagggacgtctcctacatgaggttttatgctacaatttaaactttaaattttacggaaatatcactataatactttactgcaacttagatctctcttgaatccaagaagtttgttttgcagaaatactgtaagaacagttttatagtcatcttaattttagtggcaggtccctatgacttaagaccccaaaatacattaaggtaaagttttaatgttccataaacaataccaatcatccaatttatggaacttatgttttgcttatttacagaaaaataaatatttgccccatttcaaatattttaaaggtgtttgctctattgctaaaaatgtctaacacattagacttttaatagattaatggaatggagttgtaaactattcttcagcaaacatacctttaaaggtcatgctgttctcaaaatataaattaacaagtttggttaagtgcaaggaagtagtataaaagccagcaacctcagttatattttagtcttgttatatttgtttgaatgaaaatttatcttacatagctatctttttttccaaaatgtaaaagattttccttgtgaacagacagcatttgatctaacatagttattggtctattaatttttttgtgttcttttctaccagagccatgtattcctactgcatagtatacatttttagagtaaattcttttaagaaataatttgaacgtctttaattttcagagaaaattttaggtgtagtttttttaattgcataactattttgaaactactatatagataaattttgaaattttagtaatgtggtgaaaaaattcaatgagaaagaatatccttgattcagaagctactgaagacaaataagtaaagttggaaactgttaaaggactaaaagggcagaaaaattgtcaatatcattttcttatctcttctagatatagctgacttgataaactgattattaaaagtaacaagttcacaataactgaaaaacccaagttcattttgaaccaaagattatggttaaaataccaatgccaaatttaccaaaataattacattttgcatactggataatcattatatatatagttggtacaaattaatccttagttatctatatcttagatgtctacttctgtgcctctgtgaagtaggaggtagtctaattatttccatggtatgaatatagaaattgagacttgcctaaatgtacaaagacagtaaatggccccatcagggatcacactcacatctttttcacttcacagtccagatttttaaccagaatgcgaaatataaatgtatttttgtttatattttgaaatatcatttaactatattaataattactatgcacataaacttttcaatttctttttagataaatgtttcatattatatccatttctcagctttattaactgtgttaggagtgcagaacaccgtgccttgaggaaacataaaagtacatcagttaaactgaatattaaggtttttcttctttcttctggacagcttaattgtaggagaaatattctacctataaaattgcctgtcgttaacaattcagttacagcctggtgaatgtgaacacacacactttaagtgtctaatttaaaactagattttctcctttgataattctacttttgttgtagattatataatgagtttaagcaaattaaaattatagatggcttgtgatctttctcatcaaagatgattgcatttttgtttcacttgtattagaaatttgacagatttgatctagaggcatgtacagttttgatttttaatggatttgcttggacaatctcaagttaaaataagaactttcaattctagtctctgttcagaaatcctgactcataatactgagataaatactggagggataaaatgtctctcagcattaaataactaaataacatttgtttgaaccgtaaagggagaattgagtttatttataatccatctgcataatacatctagttgaatcaatcaattattttaactgattttcttccaaattaactgctggttttatttttatgtggacattagccttattgtccaaaaaactcactctatatttctacttaagacaattaaaatgcagcaattccttattctttaatcatatccttagggtatttagtcagaatggaatattatgagtcaaagatattgatcagaagtcagtcgaaatttaaaatatcttctcttggatttattttcttcataactattatcatgcaataatgatgcaaatgcagtacaaacaaaaacatagatgaacacagatgcatttgcttgataagtacagacaaggaaacagcatggtagaaatttgcccaactagactttcattctagtagctaagctttatgctttttttcttaacttgatattttaaaaacttgaaaaaaaaaagaatcagtatcacttctcagccttttggctaagatagagtgtagtatctgttcctatcagtttaatatctgatatatcctctgtccgaggacaatatattacatggatttttggagcagggagatggaataggagcatgctctgtccactccacacattgacctggtattgcagtacctccaagaacggtgttcccctcgggggttaaaacacagtgttacaggccaggcgtgttggctcacccctgtaatcccagcactttgggaggccgaggcaggtggatcacctgaggtcaggagttcgagaccaaccaggccaacatggtgaaaccccatctctactaaaaatacaaaaattaaccaggcatgatggcgggcgcctgtaatcccagctactcaggaggctgaggcaggaggatcacttgaaccagggaggcagaggttgcagtgagccgagattgtgccactgcactccagcctgggcaacaaagtaagactctgtctcaaaaaaaaaaaaaaatcagtagaatcactttcttaaaatataagtacacagatacttttacaaatatatgatacacaatggccttcaaagtggatctagacaaatagaaatttgtttttaataatgtttagaaattatgtttctcttgctaatattcagtatcactttgttacttgaaaattctacttttcacagaaaacaacctatttttgtaggacttaggttgtcttcctgctgttaggatatattaccactacatagcagtgaggttgtaagaactcatttcttgttggaatgtattttactcagacgtggattatttcttcctttaatatatataatatacataatttctgaaattatataataaatcataaaatgtttatattcaaaacatacttttagaaatgaagacttaggtcacatttattctgttttccttatatcatcagctaatacttaatgaaaccctacccttcaccagagattttgaatagcttattttttacctactccatattttctattttccagaattatctcttgaaaaaactcatacatgcataattgaaattaaaattttaggatattccacaaagttgaatagaggttttaactaaatccatgacctcctaaacacaaatcttttttttcactgacattaaaaaaagtgtatctatagataaaatttctattatccttcaattaataataaatcacaaacatacctaattctgttaagtaaaagaccacatgtctattgaggaattgtactaggctcacaagagtgagtgtgagatgattactaagagactgtttgctatgaacagtaaaacacatttttttggtataatgtgatatatgatataaatgagcttgataaggttgtttaaagattcacaaaagaaagtagatttctggcctttcacttgatttactatgaatttctgcaaaactactgagtttcctggttgtgaaataaaaataatgactctttaacaacttgtctgactgtgcaagtgagtgataaaacttgaataaaaatgtattattcagagtagaactgaaaggtgtgaggctctagatgttaaacatttatattcataaattatcataaacactgaacactgatatgtgttcataagtaaataaataagtagggagattgaactgatagtagggagattgaactgatacctcattaaggtttttgtggctggttgcggtggctcccgcctgtaattgatcccagcactttgggaggccgaggtgagtggatcgcttgaggccaggagttcgaaatcagcctggccaacatggcataacgccgtctctattaaaaatacaaaaatcatccgggcgaggtggcacacgcctataatcccacgtactcgggaggctgaggcacaagaatcgcttgaacccgggaggcggaggttgcagtgagccgagaccgcgccactgcattccagcctgggcgccagagagagattctgtctcaaaaagaaaatatttttacataacacttttcacactcttccattttctctccactttctcttttccttctactctcttttttccttcttccattgaattttcactactctttcttcataaagtaagttgttgaaagattaaatattttactgcagttcactctgttttctacttccattcttctacaagtaggcatctatgtcaaaaaataatcagtttgaaaatctcctttattattctgtttttaagcatctctttgtctaaaagtaaaaacaaaacgtacaattaggaatatgtgctttggctctttaaggcaactgcttgccccatactctgactttagccctcaattgtcttggagatgcacagtaaaaggatatatgcctaggagaataaggctttgatgtactgtatatctaaatgttgtctgacaaaattaacacagaaaactatggatattttttcttagcgtttggaacaaacatgatacataatagattattttgctgtaattaaaatgattttctatgtctaacttaatgttcatgtacctagttttggttgtttccatttagcaggtgaggtagcaattgctttcttttgaaaatttagaccctttctactgctatcattgactttggaaaaaaggcaaaaccaaaggcaaattaaccctataataaatatattcagttgatcattcatgttaagatacttgatggcttacatttaatattagggatatttattttacattcaaaagttattcatttttacttaaaacatagaaatgctgttttttaaaaaaaggtttattgctgggcgccctgggcctgtaatcccagtattttgggaggtggagtggggcagagagcttgagcccaggatttccagaccagcctgggcaacatgatgaaacctcatctctaccaaaagtaaaaaaaattagctgggtgtggtggcatgcggctgtagaccaaggtactctggaggctgaggtgggaggattacttgagcctgggaggtggaggctgcagtgaaccatgatcatgccactgcactccagcctgggcaacagaacaagaccctgcctcaaaaaaaaaaaaaaaaaaagagtttattatcccatctaggcttcaagtaaaatgatttaaataagaagggaagttacttattcaactcaaaagaatttaaaaggaaacataaaggattttaaacagcagtattcattttctgcctttgttagtcaacaaaaaagagggtcttgagtcataatgcagacaaaaggtaacatcggctgcatattgtgcctgaataatggagatttcttcaacagaaactgtttgaaaaacatttgcacggaagtagtagattgcctttgattatattcaaggggaaggaaatagccaagcatgattttccagaataaagtaaacttttctttcattagtgaaagttatatttttggagtgatataaacactttaaaacactttatacacaaagtgaattcatatagataaattacatattttaaaactagaaatattttcacattaaagctgaaattatacatgatatgaatgcagtattaattactaatgatttgttttgcagaaagattcttcattgtgtaaatgaattcatcatagactccaaatatcaagctctcagaatgtattaaaaatggcatttgttatcagtcctccaggtgttacatatgactcccagtcacacttagatgacagtatatgtgaaagatgcttaggagaggcaagagtctgaaaggccaacatatattaaataactttatttaaatgaaacaataaaatcctgactgatttgaaagtacactgatgcattatcaatgcactttcttgaagaattggtctcgagagaaaatgcttcactgaaataattcaggaaactgcccttacggcaagtggggcagatactcttcctgtccttcatagcgttctatatgtttaaggagcaatgctgacaatcatacacatgcatctgcatgcacacattaggaaagatggagtaacatgtctatctaagttgttgttggcaatctgtgttccccctcaggggaaatctttcaaattaaatttgggcaattttctttatgtagatactagaaaaggattctctctcagctcatatttgtgtgtcttttgtcattttttcttcacagttacggttacctatgctagtacagtatgctgcacataatttagatcaattaattctgttgactaaaatacacctttttggatcccctgtttcctgcttctcaccaccacacgttgtcttgtctgctgtgcttttaacagctctcaaataagaaatttatctttgcatatttaaacatcctactcctcaccccatattaaagttacattattaagaaggcccacacattctgataatttccatatatttattaatgcccacctgcatgaaataatttttcctgcacacttagttttgtgcttttcccagatatttggaataaatctttacttattgatgtagtgatttgtatggagaattgcatattagtggaaagtctgactaaatatctatatagaatatatgaagtcggactacatgaaatttctatttttcaggtcaaaattggttaaatatcagtaattttatctatttcaaccagtaaacaaaggtcacagttcagatgtactgaaacagagaaaatcataattatcagtggaactatcttctgaatttctcctcacatctgcagatttgtccggacaattacttagtcttaagtaaaaattagtgttggagaagtctttatgaataatgcatacttctggacgaagtgagatttgatcacttctcagccttttggctaagatcaaatgaaagtcagtttataaagttgagacttccgatttaatgttaatatgagttcctgaaaaatgaaacacagttctattaatgcctcagtacaaattacccaattatgcaacataaatttcaatgaaatgtagcatcaagtaaatctattttcctattcaattacttattgaatgaataggcatttttctaataagataggcatttggatcaaatgttagcattttttgtttctgcagatttattgtgtctgcaatttaatatggattatagaaacatacggaatgaagcctccgtataattgtttatcccattatcagaaattttgcaaaatttgattcctgagaaaaaggtaaattaaagccatttgccatcagttatctttttcatttttttttctaaactcggatttcaaacagaagagctcttttttgggtgatgtccttaataattacaatctagattctgattccaaaactttactaagttttatttatgttagtgtaagtgaaaaataaacatattttgtattgtttaaagtctgtgtagtagctaagggcttaagctttcgactcatataaatcttctttcaaattttagttgtataccttaataggtctgtgaccttgggcaagttattgaaacttttagagtctcaattccctcatatgtaaacggaagtcacaataacagtgcatatatcataagactgctgtattaaatgcacttagcacagttcttggcatgtaataagaattcaataaatggtagctactattattctaataactgattacattctttggaaattgtattaagatgaccccagctgcttagtgaatcactgtatttgtcagcatagtaatttgcagaaacatggatctgtatttcctttatatatatttttaataggattaggacttgcaggagtttgctagtgtgtatatgatcttggcagcaggaatccaaatagcctgagtagaaaactgaattttcccacattttttcaatcacatagggatagagataatccccactgttggctaaattgtggaagttttacgcttcttgtattggtgggttgctggcaacagtagtctacaaataaagaatattgtttcttaatagcttaagcaatgttaacatgatacattctctctttttaccaaaaagtcttttcaaactcttagcaaaattaaacattttaaaaaatcatcgagttaattaaaagaatattgtatccttaaaatatgccattttaatggaaattttttttggtcagtgagaatatgatttatttacaataatgccacaaaatatgaagtggcagttttatatttcaagtggttctggtcatttttaattaaccggagaggaagtgagaaaaaaataaagactgtttaaaatataattaattagattaaaattttaacttttgtttatacagtctttagtaatgtatttattggcttttctgaggaatctggtatttctgaggaaattctatttttaaatacatgctactttaaataaatgttacttcatcatttgcaaatgactattcaatcaacatgtataaaagttgtggatttctttgcttttatgacaaaagtggtattgtatttttaaactgatcactttattaggtcagagagggtatagttcaaagtgtaattatttattgttaaattgtatatttacaaacattttagttttgaaccattagatatttatgtaatttaagtatgaaagtttaaaaatggttcatataataataggcatgtgataaaatgtcatgataaaagacagccaaataaatattatttcatcctacttagaaagaataattttccagaggaactttactcagttttagagagaaatccaagaatagtgttcttctttcatttttcaacatgatataatcagagaatttggaaaactggtaaatataacctatagtaaaatggtcaggaaaaatactcatttccatttatgataactgaagtgacaaaaagactcctagaagttacattttccctttgtggtatattaaagaacaatgaatataccacactttattctaaaaaggactttttttgtgaatgtaaaggataatgatcagatttaagtttctttctacaaccacttctaattctattcacgtgatctatttaaaaattccttacttcaacatatttaaatgtagtagccattttgaaacattttagtccctcaagatacagaaatatacaaaaaacatacaagtttcagatccagaattcagtttctccctaaagggaaattcatcatccaatcttctggcgttctttaaactagacactagacccttttcatctagatattgcatatctcatatatattatacatgcatacatgtatgtgtatgcgtgtatttttaaaatcagtatttgtagtaacatatcaaaaaggaatttctaatattccaaggttctaatgttagaatagaaacatattcacaatagtgtttaccagtttcatatatttagagtagtttcacactaaaatgagtgattaggctaggcacggtggctcatacctgtaatcctcgtactttgggaggccaaagcaggggggcttgcttgagctcaggagttccagaccagcctggggaacatagtgagaccctgtctctacaaaaaacatttttttttttaaattagctcctcacagtgacacgtgcacctataattccagctacaggggaaactgaagtgggagtatgacttgagctgaggagttagaggcttcagtgagccatggtggcaccactgcactctatcctgggtggcagagtgagagcctgttgcaaattaaaataagtgattaggacaaaaaagatatagggccaaataaatagaatgcttacccacctcaaataaaaagaaaataatatttgttaatatgaaggtgatactggataagtgaagtgcctaggacttttttcttaaataatctagtatattttatgtgaataagggactataaagtagggagatcagcaggactgtaaaagtgggtgtgggagaagaaagtttgctagtcaaacttggtttaaattgactgcctttgtaatagcatgtggctgaatgttttgatctatttataatgaatattttaaggatttgctaatttttgaaaattggcaagaaatactcatttttttcctgtcttgaggtatgccaaaaataaaacttgctagaataaaaaaaaatgaaagtgaaggaatgtcttgtgtgtgctaaaacacctccacttaaagagtttgatatccactagaaaatgttgtttctttaaaaaggggacaaagggcatttgatgcttctcacctttcacggttgtgacaattctcttagacatcttaaattctctaagtggagatttcttatattcttcacagtacacctgtttaaaaattgtagtccacagaaatctgaaactacaaaagaaacttttctcaagatgataactcacaaggagtgtaaattacagttacttcatttgtgggagttttcctatcacttttcaattaataagacaccctggttatgggaattttagtctcactgaaaaactcaatttttctatgcaaattaaatttgcgtatgcaagttacaatttgagtttaagcttaggcctacgctgatggagggataacaggcaaactggaatgtggtacttgaccatacttagtcagtgcaggaaaaacaacaaaaaaatcttcagaaactttcttaccattgacaggggctagtgtcgatattccttgtggttttcccttattgactgtatctacgccatcacatagcaaaatgtacacaacagcagaaagtagacattttactcatagtttctgcaaaatctgaataaagataaagtttttctattataaataatgccaaagatgtggtcttatagatgtatgcattctaaggatcagggaaaggctgtgaaataaaactctaagttgaacaaaattcaagtagtttatcttttaacagaaatatctccataaaccatatcgatataaaggtgaacaggggttggacacagtggctgaaagcccataattccagtgttttgggaggccaaaatgggaggatggcttgagaataggagttggagaccagcctgggcaacatagaaagacctcatctctacaaaaaaaaaaaaaaaaaaaaaaattagccaggtctgttcatgtgtgcctgtagtcctagttgggaggctgaggtaggaggattggtcaagccccggagttggaggctgtagtgagctatgatcgtgccactgcacttcaaccggggtgacaaagcgaaaaccgtgtctctaaaaaaattaaaaataaataaaggtcaacaggaagaatcaataactaaggcagcaactggaattgacaaattaatatcaataagcttgaatcaactaatgaggatggttttgtgtgtgtgtgtctgtgagggggagagagagagagagagagaaatattggtgaagtagtattttaattcacccaccaacattctattgggtggccaaattcatagaggtattttattagaatcagaaatttcagaattttagaatctatgtgttagcaaactgtgtattcataggttcaaaagaggttcatgacctcttgttcctcataaatcattctaggaggaaaaaaatactaacatagctgtagcccctaagtcatgaagtgcatctgactgattcacaaaatgttaaatataaagggttacagtttttcaattaaaaattttttatgataaacattaatgggaaaaaacacttatttcaataaaatttatggaattcattattactttcaaagaaataacacccttatctgttagctctgtcgatccagggatgaaggttcagctagaaaaataactttaacccattattggactggtctttattaaaggcagagatataaccctaactatctcccactcttctgattatgtatttgtattaaatacctgattatttatttaaaatttatttactcaaactatggaaacattattcaattcttcctttgtttgcaaagaaagattttctggtcaaaataataaacattaatccacagaggcaaagcaaaaataacaaagatctctgtagataatattaacttttattcaaatttcacagttgttaataaatgtatattcaaaaggaatgtgtggctgggtgcagtggctcatgcttgtaatcccagcactttgggaggccaaggcgggcaaatcatgaggtcaggagttcgagaccagcctggccaacacggtgaaaccctgtctcaactaaaaatacaaaaattagctgggcatggtgacgggtgcctgtaatcccagctactcaggaggctgaggcaggacaattgcttgaacccgggagacggaggttgcagtgagccgagatcatgccactgcactccagcctgggcgacagagctagactctgtctcaagaaaaaaaaaaaagagaggaatgtgtgatggatctggtcattgataaatctatcactaaggttctatatttatggcatttgattagctatccacatcacattatgaggatatctactttctcaaagtattttgatctttgcttctagattaataaaaaatgtaatagtggctgaagtatttaaggcactcccctgggacatgaaaaaaaataataaaatttaggttatctggcactgcccaaataattgtatacagaaagtaagagaaaattcatgtatgtttgtgtttatctgcacttacggtagctgtcttaaactttagtctttaaatatagaagccaatatggaaggttaaatagatgattaatgctcatcctttactagaagtctctttaagcatatcttatttccacgttgatcatatttatctttagtaaaattataattaacgtataaggtttgtttaatggctacaatttcagctcatttgtaattaaagtttatcgcaagtaacttttataattaagtaacttataaaatctcagattaaagtaaattatattacttagtctcaacattttcttataaaacatattcttcttctgtctttgccttatctgttcttggcactaacttcttcagtcattcacacttcaaaagctttggactatttcctcttccttatacccacattccagattaaactttagacttttttatcttgcaatctcttactcttccaatctttcttcctacatcttccagctatttatcaaaaacatttaaagagctacttctttcatgaacctcttcttaattccgttacctcaaagtattcacattcttcggtactatcatatcactttgctctgtcctttgtcacttagcctatttagtataatatttatcttctacaaatcttgtgttatctcccccactacataaacttaacatgtgctttatacacagagggtgcttaaaaagtacagatcaactggatggatgaatggatggaagaggatggaatatcttaacaaaacacattttccttaagtaaattcatgcatactccaaataaaatacagaatgtgaagtatctctgaactgtgctgttgaatatggtagctactagctacatgtgagtatttaaattttaatttattaaattaaattaagaatttaattcctcagtcgcactagccacatttcaagtggttaataggcacaagcggctaccatattggaccatgcagattattttaataaaatatttttatcattgcagaaagttctattggatagtactgctctagaaatttttgctggaggaatggatgagagaaacacgtctatggaattcgagggagatcataataacaaataataaggcataggattaccacttcccatataaaaagtatgattcatagccatttataatacaagcaattacccctcaaagttgaagatttatattagtatcattattatcacttttcatttaatccatactttttgcaacatcgataatataaaactcaaaataattcatgtaggtaggaagatgtcatattttccacataaatatgcattaaatgctttaacaagtctggcttaattagaataagaatacaacagactaggctggcttttcaaaaattttaatagcttattccctgttaaagctaagaaataccttccagtataccctacctcccaaagtatcagggattttttgttttttaatccaagagagatttatgagatcataaaacacaatctttatgttctttgcttcccttttcccaaaatctaaaattattcagaaatatttaacctattcttgatttgtagccattacagctaattggaggatcctgccataaaatgatggccctctgtcatgtgttgcctacttgtttaatttagatttgtggtttcttgaaagccaactgaaagtgttttacccctcataggaaaatcctgttgcgaataagaaggattccacagatcacataccggagaggttttgcctcagctgctctcaactttgtaatcttgtgaagaagctgacaagcttgggtgagacaatgttttgctatcctccttaaagaattagaaattgccgcataagagagtatgaattgataacaagaggcattatagctaagatcaggttcataactgaaaaatttgaaatagatatgtaggtaatcaagcatttttagtgatgtatattatgtgattgccgttcaaggcaggcataaccattttcctcagtcaggaaataaataccactagccaatggggctaggatcacacctattccatataaataaaactttgaatctatcctgtctactgtttgataagcctatgcagattatcaattttatgtgttaggtttataaaactgttataatgatccaaggaataatagcagttggtggggagggtgtttttatttaagctttcattagcagacaaataaggatagcagagacttcactccagttttaattcaaaaagtattttgtgcctacatttcagaatcctggatgatttgctgctaacagcactctgaggtcctgccatggaacctcctatctagtgcagcatttgggttattgaagccctatcttttcagtgcatctatttcatttaagtttaaactgattacaatgtactggaggcaaagacctttttcttcccctccctctttttatcccccactcaacagctgattgcagagcactatgaggactgaacgacagtgggttttaattcagatatttcaaggtgagtttcatatatattaaatatcatatacgtctcctttcctctgggtcttttcaggagtagtaattttgtctgaactccaatttttcatgtttgaagctttcattttcttaaaagatttgttttgagtttaaaatgttaacagtgagattggatgagaggaaggggaagtctatattccaatatactgatatcatgtagggagagatgtaaaacaacaacaacaaaaatcccacaaattatagtaagcataatttacctggattggcctggatggccacacatgttgtccgtggattgacaatttctaaagaattgacagtttactgacggtaaacaatgaagttgtaaaggcccctctggatcgtgcaaagatgtctttaggaccatgagttatcagtgtactgaaaaattccagaagtgcctattttcagaacaaatacttgttctgaatactacaagcaccctaggtagagagactgttcttcctcagttttgcatttccaatgcgtggtgtacagaacatactttacaaatagacaccaaactaacaaacaagagagtattctaatgaataaatatatagactttattgcacttgtaggaatatgatttgatttaataaactaataggctatccccccaaatctccatttagatgaataaaaaatgtttaggattctatttaattaaaccaaatttagaagtagtgttcagtttcttgcttgggaggttttgatttattcaaaaatcatttaagtttgtccacttagtgattagcgtgtactccagtgcacccccacaactttgtcacaatactccaataatgtaatacacttaaaaataatatatttaaattatttgtcacaaatactcattctcagtttctcttgtccatgtggcagaagatactgaaatatgttccccttgacattgctcaaagaagaaatctcttaaaagttctaatcactgttaaatttctcagacattttaagctttagagaagaaaagatttaaacaactttttacatgattctttttcttgttcccttctattccctccattactcctctgtcacttccatcattctctccaagtacataaatccactctttatggtgcctgggacctcccagatccagtaaatcttcccatcctctccctctacctttcattccttcaagttttccgttcattgaagtcattctcagttctgttagttttcccagatttctccctgttctctttgtgtgtctataattcttccaagtctctacccagtttttaagttctccatctttgttgtcaccatagttttccccagttaagttttcataacagcttgttgctcagactctatgagtacttcttattttgttagttcgtctcaatgctcaaaatcattccttacctctcaatcatcccttttctctctttaataccttcatcctttccaagttttctctgcagtcttttccatatcctctgctcctaccagtttccccttgtgcctcgcagttcttcccaaattattcaagtcccttgcaggtagttggaatataactcatcacattatttccatatttaggaacaacttaaatttacaaactgccatgaataaaacagtctgtagcttaatcattgacagtttaatataatcttattctttattgcggcattatatatacaccacattttatagacctgttatttgtaccaggtttggttttaagagaacttgagatagtagaggggagatacaaaaaattaacattcaggtagtaaagccaaattaagccaaggtgaaaatttcttattcaacaagacattcagcccattcagttcaaaacaatattctgtgtactttttaaggagtggaagaaaaattgacgagtaatggaatatgctaattgaatattgatgagatttgtttccattttaaagttaaaaaaaacaaaactgattgctctaagactttttcttgctgactgccatcacctcagttgtcatattttaaccacaaatcccgtaagcacttacatttaaccttatcgttactcttatgcttattcaaattttccccatgtgatgctaatctgaaaatttcttagaggaaatgagttttgaattgctctgaagtagatgatgacctttgatgaccagagaagatgtggaaaatattatggctagagagtagatgttggctcggctgaagaggagaggtcatggattataaattaaagagaaagatatttcttagaagcagctaattgaggaccttgaatgctaggcctcagagtttagattctatagatttcgaaaggtaataaacatagtttttttgctttcagtttttgttgttgttgttatcggtttggtttggttgttatatataatgtttatcaaaataatgaatacttatttttcaacaccataaaaacgtggaagtagaccacaaaaaaagtactggttggatagataatatatttggaaatgctttgttttaaaaaaacccttttcttctgaataaaaatagagaggagaagcagttcttacgtgaaatctctctttaacagttcctcttgaaaattagcagctgtacttagtgaaaaattatgaaggtgcaatgttgttgtcagctgtaacaggttttaattatcttttttattttaaagtcatcaaatttagagatgtcaaatttttattattttcaggacaaaatcatgatgccatagttcacatattttagttgcaaatactgtttcaaaatgcacttgattttgtgaggtgtttgctttaatattttcaacacagtgctggattacagagtttcaagatatattgcacgtatccaattaaaataactccccactttccctaatttatacttgttctttaaaaatttaaatattaattaaaatcttctaataagttaacatgttccctgttttatcaaaaacattcattgttcagtttaagcgtttgaaaaccaatcataatatctatagataaatgtcactgggatgtgtctttctcaaaaatgttatgaagggttataaaattttgaaaaaaaattttattaccaaaatattaccaaacataccttgaaagctgaatataatcattcgtcttttaaaataagctttttaatctaaattacatgaaaaaaaatttgttgccaagctgggaacaattataaaatcactaactacctaaaacagagcacacagtctttaaaccttataaacataattttaaatctgaagattatatgaaatattcatttgatgaaaagacattttgacttcgcatgtggaattgtgatgtaagatcttttaaagctgtagcattgctcataattgagatccattatgcaaatgattatgtatttatgattaaaccttctttcaatcacagatggctagaacaagaaaagatcttagagataaatcccaacgctactcaccctcagtgagtaaaatgaggcacagaatgactaaatgacttgtccaaagtcacagatacctaaaggcatagttaatactagaattcaagtccagttagtttttcccacaggattagacttgtctttgtgagtgcaggatatacaaatacctttgtttattatttttttttagtttataataacaatatcaacaattacaaacacatgtaacattaatgttccaggaactgttctaagtactttacatatattaactcatttagtgcacaataacactataaggtagacacaattgttaaccctgttttacacaaagatacagagaatttaaataacttgcataaagtcacacagctagtgagtggtggatcttggatttattataaaacaagaccatctaactccatagctcatgctaggacttctttaaaaaatttaaattttttaatgccaggatagtttatatttggatataaaaacattttatgactttactttttcagtagggtataaaaacattttttagtattggaaattaatgactgtctcaatttccatatcatatacattttgcaatagctttaaatgaatggtcttgctacaatggatgtgaagccctgaatggtttatctgaaatcatcaatattgttcattaagacaattgcaaaaaaatgatctctatggagtctttcagttcattctatgtatgaaaaaatttttcatttatttttaaaactagaaaatcaaaccgaaagtatatttaaataatgtctctatgaaatgtcttctgtgagaatggtaaaatgagctatcaactaattattttttcatatacttggtaatgactatgtgaacaaaattgattttgcattttctcattaatgtggcacacaacacagaaataaaagtcctatttttttctagcttgttttagtctgtgggcttaattgctagtttgaaagtaatattaggtaatatcttactctgtaagaaagcatattttgacatgttgacgtgttaatatattgacacatgggaaaggaataagtaaatgtaaatgaaaactaattaagcaacattatatagtggatatgggaaaggtaaaaaaatatcccagcactttgggaggccaaggtgggtggatcacctgaggtcaggagtttgagaccagcctggccaacatggtgaagccccgtctctaccaaaaatacaaaaattagctgggcatgatggtgggtgcctgtaatcccagctacttggtaggctgaggcaggagaatcacttgaacccgggaggcggaggttgcagtgagccaagattgcaccactgcactccagcctgggtaatagagcaagactcagtccccacacccccccaaaaaaaatctccaatacgcaaaatgcctatataagtttgttttatgtataattatgtaataaattctgaaaattatcataaaattaaaatattagaatataagatcttccatacattgccccaatttgtttattccgttcaaatagaatggaaagacaaattaaaatggagaagggctgactcataagaaatagcaatgaattccttttcttttcattttttagggaagaaagggattgggaacaagactatatgttgtatagggaacattgaaggattctatttccatttcagtgcttaatggcttttactagttatttaacttttttctctacgtttttaaaactctcagagtctgtggcttcattaaatattatttctttataaaacatatatgataatacgaaaagtgttaaatcggtggtattcattaagactgtatccagcactgtggagaacttggaggtcaagggaaagtctgcacaaaagtagaaatatgaggaaatttgtgaactgtgttagccaatgtatattagtgctctgagcatatatttaaggaaggatgaggcaatgtggactgagggacattggagatggattaagagtgaaagggtaattggctatgttagaaaacagtggcttgcattgcatgattctgtatcacaggtacttatttatagtgtgcatgcatttctgatattgcataaagcaagacagtgatgaagttacatagttgtctattaggatatttgccctatacccttcagttttctgtttgaggtttttgaaggattcatgatttctatcatgcatcatattcttcatactatctgtataaggattatgatggtgataaatgagaagaacatggtgagtattccaaactcctatcgaccctacccaatatactaaagattatcaagtggagagttattttggtatattaccacttcataatttttatgtctcagatacagtacatttatttatatagcatatcacataggttttattgggatcatataatgttttatgaaataattctattttaagatgctatttactcataactataaaactgtgcatttttgttctctcagaggatctggaacagtgtgatttctaacttaaaatgaggggagatttgattgtttcttcttgagttaacaagttaccaatatcttaaaaatattcactgcctaatagtttcaaaatttagaatcataaaatactactcattcctaaatgattcaagaatacattttactgtactatttaattttataccttttttgtcccctgcctatgaattggatattctagccatcatttcactgtcctgggtgcaggcatagttgaaggttactgaccttctgatctagattagtactgtccaacagaactttctgtcgtaatagaaatattctaaaatctgtgctgtccagtgcttaagtccttagccttattggacaattgagcacttaaaatgtgcttagtacaactaagggattgaatttttaatctgacttaaatttaattttaacagctacacacagcaagaggtactatattggactgcacagctctagatgcttatagtctaaatataactattgtatggaaaagagagttcttttttcaaggcataatcaatcaccttcgtttctaattttgttcttgtgctatctataaatcaagtcctgatgcaaagtaatttcatcatgaagagcactggtctttattttccagggttgacaggttatataaagaattaatgtaccctgtgatcgcaatttcctagagtgagtgccagttttagcaagtgtaaaatagttgtgtttgttgtagcttcttctatgatatctattaaggagttggatatctctgaaaagaaaatataaaatatttcagcatttctaatattttctggaataggaaaatattttacatttatcagctataaagaaatcataatttaaaatgaaatactggccattttcacatattttgtactctgtgacaaactgaaatcattacagagtatgttataattctaaaaaccaaaaagtctcccaagtaataggagcctctagtacctaatcaaaagaatggtgtctttattttcttttttcgtaatctctttttctaaaccaatgtgagatcaaattacgttttttataagcagtgcaatagctaaataaaaataacaataaccgcaaatgcatgaagaatttttttttttatctgaatgtattactcacttaaaactgcattggtggactgggcacgatggctcacgcctgtaatcccagcactttgggaggctgaggccggtggatcatgaggtcaggagatcaaaaccatcctggctaatatggtgaaaccccatctctactaaaaaaaaaaatacaaaaaattagccgggcatggtggcacaagcctgtagtcccagctactcgggaggctgaggcaggagaatctcttgaacctgggaggttgcagtgagccaaaatcgcaccactgcactccagcctgggtgacagagcgagactctatctcaaaaaaaaaaaaaatgtattggtatggaaggcaatgaaagttctattttggggctgccttaatgtgagattaaccctgatcacaccacttgcatttcaactattgtttagtatgatggcatttcaattggcagttttccttacagtgatctgtctacacatgcacgcacataaatgcacacaagggcatatgttcacagtgaaacacaaagattattattttaaacatacaaataaagcatctcatgaatatttctcaattacaagttggctagtgtttgttagtccagcaagcaatactgtatccaactctgtacaggcagaacttgtatattcttgatttcccatttgatggttacttagaattgttttgaggttaatgcacttcttgatttataaataaaagtggggttgcatttcattcttcttccaatatactattatattacccctttgaaggcttgttctttacttgtggtgagaaggcatggaatatgctgaatgaaggctaatgataaatcatttttcatttcttaatgagttggagtggggtttgtggttgtcctaagtgagaaacagaaaaaaaaatttaaagaagaggaatctaaaaatattgtgaaaacatgtaggattagttaaattaatttaaatattttacttactaatagtttgaaaaactgatttcctaagaaccacttagtataatttgtagtgaaaataactacaggtgaagatcatgcataaaatatactcttaccagaaaattttaggtttttgaataaaatggaattcataaaataatgaatactccaagttattataaatcactccgattatttcttgaagtctttgctggttgttgtagtcatatattcttggaggaaaaggtttaaaacaaaagaattggtgacccgaatctccagcaagcatttctttttttttttcctttcttttttttatttttatttttatttttattttttattattatactttaagttttagggtacatgtgcacattgtgcaggttagttacatacgtatacatgtgccatgctggtgtgctgcacccactaactcgtcatctagcattaggtatatctcccaatgctatccctcccccctcccccaaccccacaacagtccccagagtgtgatgttccccttcctgtgtccatgtgatctcattgttcagttcccacctatgagtgagaatatgtggtgtttggttttttgttcttgcgatagtttactgagaatgatgatttccaatttcatccatgtccctacaaaggacatgaactcatcatattttatggctgcatagtattccatggtgtatatgtgccacattttcttaatccagtctatcattgttggacatttgggttggttccaagtctttgctattgtgaataatgccacaataaacatacgtgtgcatgtgtctttatagcagcatgatttataatcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttctttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtcctttgcccactttttgatggggttgtttgtttttttcttgtaaatttgtttgagttcatcgtagattctggatattagccctttgtcagatgagtaggttgcgaaaattttctcccatgttgtaggttgcctgttcactctgatggtagtttcttttgctgtgcagaagcactttagtttaattagatcccatttgtcaattttgtcttttgttgccattgcttttggtgttttagacatgaagtccttgcccatgcctatgtcctgaatggtaatgcctaggctttcttctagcgtttttatggttttaggtctaacgtttaagtctttaatccatcttgaattgatttttatataaggtgtaaggaagggatccagtttcagctttctacatatggctagccagttttcccagcaccatttattagatagggaatcctttccccattgcttgtttttctcaagtttgtcaaagatcagatagtcgtagatatgcggcgttatttctgagggctctgttctgttccattgatctatatctctgttttggtaccagtaccatgctgttttggttactgtagccttgtagtatagtttgaagtctggtagtgtgatgcctccagctttgttcttttggcttaggattgacttggcgatgcgggctcttttttggttccatatgaactttatagtagttttttccaattctgtgaagaaaggcattggtagcttgatggggatggcattgaatctgtaagttaccttgggcagtatggccattttcacgatattgattcttcctacccatgagcatggaatgttcttccatttgtttgtatcctcttttatttcattgagcagtggtttgtagttctccttgaagaggtccttcacatcccttgtaagttggattcctaggtattttattctctgtgaagcaattgtgaatgggagttcactcatcatttggctctctatttgtctgttgttggtgtataagaatgcttgtgatttttgtacattgattttgtatcctgagactttgctgaagttgtttatcagcttaaggagattttgggctgagacaatggggttttctagatatacaatcatgtcatctgcaaacagggacaatttgacttcctcttttcctaattgaataccctttatttccttctcctgcctaattggcctggccagaacttccaacactatgttgaataggagtggtgagagagggcatccctgtcttgtgcccgttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggccttttctgcatctattgagataatcatgtggtttttgtctttggctctgtttatatgctggattacatttattgatttgagtatattgaaccagccttgcatcccagggatgaagcccacttgatcatggtggataagctttttgatgtgctgctggatttgttttgccactattttattgaggatttttgcatcaatgttcatcaaggatattggtctaaaattctcttttttggttgtgtctctgccaggctttggtatcagaatgatgctggcctcataaaatgagctagggaggattctctctttctctattgattggaatagtttcagaaggaatggtaccagttcctccttgtacctctggtagaattcggctgtgaatccatctggtcctggactctttttggttggtaagctattgattattgccacaatttcagatcctgttattggtctattcagagattcaacttcttcctggtttagtcttgggagagtgtatgtgtcaaggaatttatccatttcttctagattttctagtttatttgcgcagaggtgtttatagtattctctgatggtagtttgtattcctgtggatcggtggtgatatcccctttatcattttttattgcgtctatttgattcttctctctttttttctttattagtcttgctagcagtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattatgatactagggtgtcaattttggatctttcctgctttctcttgtgggcatttagtgctataaatttccctctacacactgctttgaatgcatcccagagattctggtacgttgtgtctttgttctcattggtttcaaagaacatctttatttctgccttgatttcgttatgtacccagtagtcattcaggagcaggttgttcagtttccatgtagttgagcggttttgagtgagtttcttaatcctgagttctagtttgattgcactgtggtctgagagatagtttgttataatttctgttcttttacatttgctgaggagagctttacttccaagtatgtggtcaattttggaataggtgtggtgtggtgctgaaaaaaatgtatattctgttgatttggagtggagagttctgtagatgtctattaggtccgcttggtgcagagctgagttcaattcctgggtatccttgttgactttctgtctagttgatctgtctaatgttgacagtggggtgttaaagtctcccattattaatgtgtcggagtctaagtctctttgtaggtcactcaggacttgctttatgaatctgggtgctcctgtattgggtgcatatatatttaggatagttagctcttcttgttgaattgatccctttaccattatggaatggccttctttgtctcttttgatctttgttggtttaaagtctgttttatcagagactaggattgcaatccctgcctttttttgttttccatttgcttggtagatcttcctctatccttttattttgagcctatgtgtgtctctgcacgtgggatgggcttcctgaatacagcacactgatggatcttgactctttatccaatttgccagtctgtgtcttttaattggagcatttagtccatttacatttaaagttaatagtattatgtgtgaatttgatcctgtcattatgatgttagctggttattttgcttgttagttgatgcagtttttttctagtctcgatagtctttacattttggcatgattttgcagtggctggtaccggttgttcctttccatatttagcgcttccttcagcagctcttttagggcaggcctggtggtgacaaaatctctcagcatttgcttgtctgtaaagtattttatttctccttcacttatgaagcttagtttggctggatatgaaattctgggttgaaaattctttcctttaagaatgttgaatattggcccccactctcttctggcttgtagggtttctgccgagagatccgctgttagtctgatgggcttccctatgagggtgacccgacctttctctctggctgcccttaacattttttccttcatttcaactttgatgaatctgacaattatgtgtcttggagttgctcttctcgaggagtatctttgtggcgttctctgtatttcctgaatttgaatgttggcctaccttgctagattggggaagttctcctggataatatcctgcagagtgttttccaacttggttccattctccccatcactttcaggtacaccaatcagacgtagatttggtcttttcacatagtcccatatttcttggaggctttgcttgtttctttttattcttttttctctaaacttcccttctcacttcatttcattcatttcatcttccatcgctgataccctttcttccagttgatcgcatcggctcctgaggcttctgcattcttcacgtatttcttgagccttggttttcagctccatcagctcctttaagcacttctctgtattggttattctagttatacattcttctaaatttttttcaaagttttcaacttctttgcctttggtttgaatgtcctcctgtagctcagagtaatttgatcgtctgaagccatcttctctcagctcgtcaaagtcattctctgttcagctttgttccgttgctggtgaagagctgtgttcttttggaggaggagaggcgctctgctttttagaatttccagtttttctgttctgttttttccccatctttgtggttttatctacttttggtctttgatgatggtgatgtacagatgggtttttggtgtggatgtcctttctgtttgttagttttccttctaacagacaggaccctcagctgcaggtctgtcggagtaccctgcagtgtgaggtgtcagtgtgcccctgctggggggtgcctcccagttaggctgctcgggggtcaggggtcagggacccacttgaggaggcagtctgcgtgttctcagatctccaactgcatactgggagaaccactgctctcttcaaagctgtcagacagggacatttaagtctgcagaggttactgctgtctttttgtttgtctgtgccctgcccccagaggtggagcctacagaggcaagcaggcctccttgagctgtggtgggctccacccagttggagcttccgggctgctttgtttacctaaggaagcctgggcaatggcgggtgcccctcccccagcctcgctgccaccttgcagtttgatctcagactgctgtgctagcaatcagcgagactccgtgggcgtaggaccttccgagccaggtgcaggatataatctcgtggtgcgccgttttttaagcccgtcggaaaagcacagtattcgggtgggattgacccgattttccaggtgccgtccgtcacccctttctttgattaggaaagggaactccctgaccccttgcactttccaagtgaggcaatgcctcgccctgcttcagctcgcgcacggtgcgcgcacccactgacctgcgcccactgtgtggcactccctagtgagatgaacccagtacctcagatggaaatgcagaaatcacctgtcttctgcgtcgctcaggctgggagctgtagaccggagctgttcctattcggccatcttggctcctccctccagcaagcatttcttaagcacttactgtgtatttggtacagtgcccatgaactgctcagttaaatataatgtcttaaaattgttggtatatatttggaatgattcatttgctttgagttgagattcataatataaaatattatggatctatacagttgtttacatttaaaactgatatttatagagaataaattttatatctaaattgttatttttgaagagctcaatctttgtgtattacgtagggagttgtcttgagaaacgtctaatttttaccgctcatctttttgcactttcaaatatactaatacttttgaagcaggacccaacaggccttctctaaaattaagttttctcacatgtagcaaggttattttgaatgcccaaattgaagtttaaatggttaatattacatttatatttggagttaaaatgtattaagacacagttgaaatagtaactcattgtaagtatgaagaatattgctaaatagagaaaacattttcttatgtatttacctagatgaaagagaaaggaaaaattatacaaacactatcatttataccttatctttgtaagaacatcttgtaaatacatttgaattttctcttatagatgctattccttcctgaaaaccaggctgaacccagtacatgcttttatagtgaagtaaagaacacacaagaagtagggtttattttaacttataaatgcaaattccattttacttattttttaatgggaaaaatatttactttatttctttaacttttattttaggttcaggtatgcatgtgcgggtttgttatataggtaaactcatgccacaggagtttgctatacaaattatttcatcacccaggtactaagactagtatgcaattttttttttctgctcttctccctcctcccacgctccatgctcaattagtccctagagtctgttgttcctttttttgtgtctatcagttctcatcatttacatcccacttaaaaatgagaacattcaatatttggttttctgttcctgcattagtttgctgaggataatggcctccagttccatccatggtcttgcaaaggacatgatctccttagtttttattgctgcatagtattccatgatgtatatgtaccacattttctttattcagtctgttattgatggacatttaggttgattctatgtatttactattgtgaatagtgctgcagtgaacatttgtgtgcatgtgtctttatggtaaaatgatttatattcctctgggtagttacccagtaatgggattactggtcaaatggtagttctagttttacctctttgaggaatcactatgctgcttcccactatagttgaactaatttacactcccaccaacattgtaaaagtattctcttttgtctgcaacctcgccagcatatgttatttttgacttgttaatagtagccattctgactagtgtgagatgatatctcattgagattttgatttgcatttctctaatgatcagtgatattgagctttttttcatatgcttgctggccacatgtaagtcttcttttgaaaagtgtctcctcatgtcctttgcctacttgttcatggggttgtttttttcttgtaaacttaagttccttataaatgctggatattagacctttgtcagatgcatagttagcaaatattttctcccattctgtagactgtctgtttactctgttgatggtttgttttgctctgcagaagctcttaaatttaattagatcccatttgtcaattttgcttttgttgtgattgtttttggcatgttcatcatgaaatctttgccacttcctttgtccaggatggaattccctaggttgtcttccaaggttttatagttttgggttttatggatatttaattcattttgagttgacttttgtacatggtgtaagaaaggggtccagtttcaattgtctgcacatggctacccagatgtcccagcccgatttgttgtgtaaggagtcttttccctattgcttgttttcttcagctttgtggatgatcacgtggttataggtgtgtggccttatatctgggctctctattctgttctattcgtctatgtgtctgtttctgcaccagtaccgttactgtagccctgtagtatagtttgaagtcaggtaatgtgatgcctcatgtttcgttctttttgcttaggattgccttgactatttggggtctttttttgttccatatgaattttaacatagtttttttctacttctgtgaagagtgtcattggtagtttcatatgaataacaatctgtaaattgttttgggtagtatcccattttaatggtatttattctttctatccatgaagtagtgtttgattatacttattaatgcaaattccattttaaaaggcagaattctttttttttttttttttgagatggagtctcgctctgtcacccaggctggagtgcagtggagcgatctcagctcactgcaagctccgcctcccgggttcacgccattctcctgcctcagcctcccgcatagctgggactacaggcgcccgccaccacgcccggctaattttttgtattttttagtagagacggggtttcaccatgttagccagaatggtctcgatctcctgacctcgtgatccgcccgcttcggccaaaaggcagaattctttatcattttttctactctaagtgtatcacaactgaagattcgaaatatggcttgtgggtgtcacatttatggttcagttgtttttctattcatttattaattaatgttgtcatttttaattggttatccatttttttggttttgaggtgacacaaaacaaaaatcacagaaataatattaaaatatgtgtaaaaaactgagaactaaaaggagaaggaatattgttgaacctttaggctgaggcatctgttattaggcagttgataaaccaagtcgtaagattggttttaaaaggttgctatgtcatttttgcttagcgttctaagatgtgtagttactgattatggattgtgcaactccaaagtcgtcttaataggaagagcttcattgtctcacggggtgaatgaatgcaactattaaagtcatttctctgttccttggaacaataagttgatggatataattcattttctgacgactaatatcttaccttgatttgttttacagaccatcaacttggatcttgtttttagccatcacttccaagattctagtgctatatctcatttgctttcaactgttgattttactgcattgtaatttgataatttagaccccaacacaaaaaataaattaagtcatgctagaatatgcaccatacgtatataggggagtaatctgataaagtgctttgtgcagatattgcaattagtactgaagtttggggaggtgtgcaatcaatagtaaaatattaattggtctttctacatagataatttaaacactaatatgatagatatattactacctgttttcctgtactgttttattaattcatggaatagtgactaatagaagtattatttagccttatatataaaactcatagatataatactgttttgtgtactgttttattaattcatggaatagtgactaatggaagtactacttatccttatatataaaactcaaaataggcttttcaacaaatacccagtgaagacacaaatatatatattacacacacacacacacacacacacacacacccacaattatatatatatgaagaaaccacatttgttaacaaatgactaaaattgtcatgcctgaaccctccattattgaacatcacctctccataccccttgatctctttaattttgtgatgctataccacctccataatttcacccacgaataatagattccaagcccatcactttctgtttctttctcttttcttttgcaaacacttttcctttacacgagggacctttggttaccttcttaaaatgtgatcatctagagaatttacagaatgtgaaattaatgcctatttgataaaaaatatttaatatataaagcaatgcctacagatatgtatatatatcacatagttgttatacagattaaatgaaataactgatttgaaatcacatagagcaattcaaatactacaccaagtggaaattatcctttgaactttgatgaatttaggacttatttattatgataatctggtacttgttgacaaagtacagtaaaataattattagatactgaaacaagcaatattacattcaccctgaggcaatagaagaatgtgtgatgatagacaaacgttatatttttgccatgaagaatgagtctcttgcttgattattctgtaaagccatgtttcaaatgttccctaaatcatatatcaaaaatccagaaaaattaatatagaagagcaacctttagaatttgtcttattaagtgctatttgagcttgattattatcagattttgaaaccctgttagagaacaccacactaactgttgttggaatgctagaatgaatcagcaaacaataaacaatttggagaaggaagcagcattgatggaatccacttctcagagaagtttagacccaaatgtgaaaaattagacatgtacaataagcacagtaagcaagctgtttgtggaataaaatttaacaaaccagtcttataattactgtgccttattaaattttttattttgacatctcaagtttcagaatacacaggaaataattacataaaattggacagccaatgcccttgcccgcctctgcttgctgtggtcagttcctctgaaaatactaggtttatcggttgctccaatttgtctttctcccaatgtggttacttttattgcaatgttctagattcctgtcaacctcaagaactaccttattgtttacccaggctgtgaaagaagctttgcttgtatttgagaccaagaacacaacagtagtgaccacctaatatattatggctgttaaatggtgtatttttgacttaatgaatcattgaaataattggaatgatgagatttaagtggagttaggataatgggcagcagatagatatttcttatcttcatgtaatacttaaatttgtactattgtagaaattgtacaaaaattgtagcatataaaccattcactcatgtgtttgttgttctagcatatgattcagtaattcacatagaattcatttaaatatattacaaatgaaaccagcactataatgaagaaaaaatttaaaaaatatcaaggaaattatgccttgaaattcttctgacaaagcatttgaacattaattgtgtggtttgaaatttctagaattgcatatagtagatgcctagctcccttacctactcagagatgataaaatgaacttccatttttgctttatacatctttaaattttcagagatgcttattttatttctgcttttgctttctctaattgtcattattgtgtccctctaaatacaactattgcttacccaactgtgatgtcttgctgataaagggcatcacttaaatagcatgggcactactggaacttgtcaaaaattttagttctttatatcttcttttgtgttgtttcctttatcaatttccaaactaacattaatctatagtaggagtgggttgtaggagaagggcaaagaaatttaaggttaccttgtcacatttttcatgagacagaaaaattagaatgtaatttacatacattaagatacgtatgtaggcatattttccctggatatctgagttaaatgtgccatgcttccataagactaagcagtgattatttatatccgtatttagtagctaaatttctgtactgttcattcaaagaattaaactcagcattttcaaagaaaacttaataaattttaaagataataaattttcaagtggcaaatgtgagagttgaaatcaaaatctggagattgaggttacttaaacatgcatgttcacatcctggtagaagcagagatgagttcattatacagtaattgaacactgaattaaagacatactagaatatattatcaaatataaactctgttttgttcactgatgtaccttcagtgtctagaactgtgcttgacatataaaaattgcttaataagtatttgttgaataagtggctaaacctccatgagttcatttcatctcaaactctttattaactagagggtgaatattccttctaggttggcaacatatatattcacttaagctttagaaatggtattttttctcaatatttcttccccgtttttaaaaccactgaatgaatttccagttatgaaacacattttaaaatgttttatatgatgatggtattgtggaagacagtgtggcaattcctcaaggatctagaactagaaataccatttgacccagccatcccattactgggtatatacccaaaggattataaatcatgctgctataaagacacacgcacatgtatgtttattgtggcactattcacaatagcaaagacttggaaccaacccaaatgtccatcaatgatagactggattaagaaaatgtggcacatatacaccatggaatactatgcagccataaaaaaggatgagttcatgtcctttttaaggacaaggatgaagctggaaaccatcattctcagcaaactattgcaaggacagaaaaccaaacaccacatattctcactcataggtgggaattgaacaatgagaacacttggacacagggtggggaacatcacacatcggggcctgttgtggggtggggggaggggggaagggtagcattaggagatatacctaatgttaaatgacgagttaatgggtgcagcacaccaacatggcacatgtatacatatgtaacaaacctgcatgttgtgcacatgtaccctagaacttaaagtataattaaaaaaattaaaaataaagatagagtagaacagatttagaatggattgagggagggtgacttcttggaactagatcgctctattaattatgttgtgtagagatattgcgacatgcatgcaatgcttttatttctttagtttgctttattttgtttttcattttggggggttatcccaggaattcaaggttgttttatcttatttttttttaatttaacttttattctgagttcaggggtacaagtgtaggtttatgtaagtaaacctgtgtcatgggggtttgttgtacagattatttcgtcacccaggtattaagcctagtacccattaatttttcctgatcctctccctcctcccatcttccaacctccaataggccccagtgtgtgttgttcccctgtatatgtccatgagttctcatcatttagctcccacttataagtcagaatatcctgcaatgtttttaaaaacagtctgtagtattcttctgccagttgtaataatgtgtaatacctaagggtaagataagaatagagcgataattttaattccaattgtcactgccccatttttatttctgcttatgtttgcatgacatttataaaatcacataaacatccaaaacttcttagatatgctagattcacagcatatagaatacatatatgtgtgcatattagctggtagtatcaatggggtatttttaatctcaccttcataacagagtataaaaccaaaaattcacaagactgaattttgagcgagtttttatattatgtaatcccaatgcacatcattgtacaaatgatgctaaaaatactataccacaggcaacagtgtttttgtgttgtttactaggataaataatgtcttcagctctagcattactcactatcataactaacatattttatgtatgataccaactgcttaacataggaaagtcattgaattcatagtatatatttttaaaatgttgtgataaaaattaatgagatattttaagtctactcctgacctaaactatcttgattgttgcaacagatgcatttatttgattattgattgtaaataggaagatttctttttttccaattttgtgtattccaacattggcatatgcatagtttaaaaaatgcggatgtgcagctatgcaatgggacagttatttcatataacacattgcttggcataaccagagcacaatatccataacaagttatttatatcatatgtagtcctcctgtttttagaacaattactaaaacttgttgatgttatcgattaccaataaatattgagaaattccttaactggatacctatatgcattaatacatttctggaatggaattttaaataaccatctgaccactgagttttcaaaactgctaaataccttaatagttgcattaaccttcatttaattataaaagtatgacatctgataggctttagctcagtgtgatacaaatttaattttgtttatataatatatcatctacaaatactatccagaagaagcacattagaatgtttaattatactagagattaaaagatatttaatatataaacttgagaataaataaaatagagaataagaattgagaattacgaaaggaaactgaagataaaatttgcagattttaagaaaatcaaaattcctcattgaattttgtcagaagagttcaagaactgaaataattttaaagctttcagtgagtgaaaaataatagggagaagtagcaagagagattgatttttgactcactttcaactcggtactgtttttaaatgcctttcttattttcaagcccttctcaagctgttccttgaagttgtataattcctgttagtctatagatgtgaaaacccatttttatatgaactaccttctgcgttctataaacataaattctcagggttgggatgtcttctagtctaactctcccattgaatgtttggacgtcatctaccaaatccatatatctaaagcaaatatagtagatctaatctggtggtccagtacctccaaagatatggaatacactcctgaaatatcctgaaaacttttttttttcagaatcctttaataagcagttatgtcaatctgaaagttgcttacttgtactttatattaatagctattcttgtttttcttatccaaagaaaaatcctctaatccccttttcacatgatagttgttaccatgtttaggcattagtcacatcaacccctctcctctcccaaacttctcttcttcaaatcaaactttattagtccctcctttataatgattccttgcctcgttttatccagatcaattttttttcactttgatgcccagagctgaagaaatggactactgtataaattattcattgccaagagaataattgcattttaaacccatattataacaaagaataatgattatattttgtgatttgtaacaaataccctttattttcccttaactattgaattaaatattttaattatttgtattctctttaactatcttggtatattaaagtattatcttttatatatttatcaatggtggacacttttataggtactctgtgtcatttttgatactgtaggtatcttatttcatttatctttattcttaatgtacgaattcataatatttgattcagaacaaatttatcactaattaacagagtgtcaattatgctaacatctcatttactgattttaatttaaaacagtttttgttaacatgcatgtttagggttggcttcttaataatttcttcttcctcttctctctctcctcttcttttggtcagtgttgtgcgggttaatacaacaaactgtaacaagtgtacctggtatggacttgttgtccgggacgtacattttcgcggtcctgctagcatgcgtggtgttccactctggcgcccaggagaaaaactacaccatccgagaagaaatgccagaaaacgtcctgataggcgacttgttgaaagaccttaacttgtcgctgattccaaacaagtccttgacaactgctatgcagttcaagctagtgtacaagaccggagatgtgccactgattcgaattgaagaggatactggtgagatcttcactactggcgctcgcattgatcgtgagaaattatgtgctggtatcccaagggatgagcattgcttttatgaagtggaggttgccattttgccggatgaaatatttagactggttaagatacgttttctgatagaagatataaatgataatgcaccattgttcccagcaacagttatcaacatatcaattccagagaactcggctataaactctaaatatactctcccagcggctgttgatcctgacgtaggaataaacggagttcaaaactacgaactaattaaggtgcgttttaaaatcactttgttaaagatatcatctcattttttaaagagtaaaataaaatgatattaatgtatttcaaattttgagtaagccatcaccccaatttttcaaaatttatgtaatttaaagcatagtggagaaaattcatcaatgcagtttttgcaattacaggtggattatgaattttcatggtatgtatattcattttcaaacagctgtgtttccattaatctataaagggatcagacaaggtcagccctgctacttacaaatcagtagtttgcccagcttcattcttttaatctgtccagtcatgcttctgccaaaaacttgatataagcaaatcattaagaatgaatccataaatctgattatcaatttttcctagtgattactttagatacacaaattttatcttgccatttgatatggtgccaaataaatctatttgagaggtgactagaacaatttaatttattactagcatttctgaacatatatagataaatatttttcatgaggatttcaaggtaaggcaaggtctttagcatatcctgtatcatcaaattgagattaaattttagtcaatattctgttaatgttaaatattttcatttttttacaattatttgaaaacagagtgttcatttgttgtaaagggtaagtaagccttttaacaaaaaagagtcaatcagttaatttgaataacctactctggcttgatttgggtcttaggatggagaagttagagagaagaatagatagaatatttggtattcttcaaaatatgtgcagaggggccacatttatcaagttaatgatcaattcttttaaattacttatatgatataaagagaaatagataactcagatttgggtatgtgaaatagtacaatgcacttgaatgatcttggaaaatatatgttaatgaaataactaatgtgcatgtttcagatagatatgttcaggggattttcacacttttataaatattctgccaaactatgatctatataataactagtgttaaaaatatgccccaaaacatataaataagacattctgatatatatcatctgaaggttttgacctggaggatatataatatgggaaaatttctcaactaatgctgatctattgtaaagatatatttatttataaattcattcaggaatggaaggctacaaacctcttgagcaaatttcagtgaaatgcagatatgtttgagtatatgaagtgaaaacagaaagagaaggatttggaaagaagggaactcttgaatactgttggtgggaatgtaaattagtacaaccactaaggagaacagtttcgaggttcctcaaaaaaactaaaatttagatgatttttaagtgagcactttggggtgaagttcctgcaatgacatctccttatctgatgaaatggaaaaatattcaggagtcagatagatatggatcacagttttatgcttacctcttaccagacatgctactttcagcttaatctttttgacctttaatttcttcagtcataatatgaggatgataattatcacaggggcagaattgggaagaataagcacttagtatggagtagacatacctgcatagaagatttttgaacatgctttaagacatttaagtacttatagaagtgtgaggcttatcacttgacataataaattgagtaacagagtggacagtctctctctaaagcaacacttcacaacagaattttctgcaaggacggtaatctgtgtgagaacaatgcagtagccaccagtcacacgtagctgtagagtccttgaaagtacttagtagctagtgctactaaggaactaaatgcttaattaattccattttaattttaatagccacatgtggttagtggctatcatactgcacagcacagcctaaacaaataaaaaacgtttatttggacaatacaaattaatagataaaatcaaaatgagaccttaccaagtttaaatcagatattagcaatagggtctcttcaactgaccatcttgacaaatgtgttgttttaaaacgtagtgctttattcaaagaataattttgtcgtgtctcccttagggcagcttaatgaacttccaagaaatttctgatttgtcttgaaagctgcttaactaattcaaataaaacaaataagcctgctggcataattttagctttgttaaaatgtgctttcatttgacattctttgaaagattgtcagcaaatgacaaaaagtctcactacaggttcttagatgagtcttagaaatgctctaaaatttctttctgttttagaatgtgtgataagcctaaagtaactatatgatgtgcctaaagtactggggcatttgtgtggccccgtggacaaatactgttttgactgcttgttaaaaataatgagaatggaacacaaagcatagccccaggcatgcagagggccatgacatgggcgactttaactgaatgcactttgactcgcaaaaaggccctgtcatgaaagtggcatatatgctatgggaaaggagacttaaagaaaaacagagaaaagaagcatgtgttgattcatccataaactttagtaaattttacaatgtgaaataagtaggccaaccataataatttcttttaaaaatccctttgtcctgcagaataggatgagaatttaattaatattaatttgctctacttttgttgaatagacaagaatagaaaaatcaccatttatcctaactaggctaatataaaatgtatatgaatagttcaaatagcaaagggagagaagggagaaatatagagaaaaattctaggaaaaaagctcaatttaaatatttaaataggtcaatttatacatgaaggtgtcctactatttactatttgatattaattaactgaaattaaaggcattggtggaaaatatttattaaatgtttaaaatgtatgtagtataaaatttcataagacttaaaacttagaatatttatttctaaaactaatatatacatatattaatttagcttacgtttttatgagtttcagtataccttggcacaaacagggaaagtattatttcacattttaaatatttggaaaatgagtttcagagtgataatgtattatgcttatcatcatatgactggtaaatgatagaggtaggaaccagagtgcagttcctgactcctaatcaacagacagattgtagatggatagataaccttcagagcaggatcactgcaagttcatgatacaaaacgaaaagagtgaaagaaagaaaaaagactgggcacagtagctcacacctgtaatcccagcactttgggaggctgaggcgggtggattacttgaggttaggagttcgagaccagcctggccaacacagtgaaaccccgtctctactaaaaaaatacaaaaaaaaaaaaaaaaattagccaagcatggtggcgggaggctgaggcaggagaatcacttgaattcgggaggcagaggttgcagtgaatcgagattgcgccattgcaatccagcccaggtaacagtgaaagactgtctccaaaaaaaataaataaataaaattaaaaaaattaaaaagggaaaaagtgggggaatgaagtgattaccaagtaattctgcttgtttaaaaaataagtaaaaataaaacttatttatgtgactttgatgcgattaattttcaactttttaatggatcatgttactctttaaagaaaaaaaatcatctataagagttcttgatgttattaatagttaccacttaaaaaagaatccagatttgaaagcttctcttttctctctttcaagtaaaatcatactgcaatgctaattccctatatacatatagctatttacatactcacacacatcgtactacacattgcagtatttcgaagaactgttgttcaggagtaggaaatcacagatctctttaactttcactttttaattcagatggcctgttatttataaagctttttaaaatattgtaagtattttttgacagggaagccaacattttcacaaatagaaacatccctcaagcacccagtctgactcagaatatgtatataaaccacagggacttccttcttttctcatggtaggaactcaggggaaattagtttatataatgatgttacagttatttttattttctgcttcaaatttccatcttccctggcatatatcaacagtcacatttctgtactagcccagtgacagtgtgctgattgatttccttaaggcaggcatgacagtgtttcaaaggttgacaatttttgttgacagaacatgaagatcaactttttctcaggttagtgatcctactcaaggccttcccttgtttctacccatcccataaggcatcctcatcttttccatgaatctcaaaagatcatttaaactggggtagtcttttaacatagtcaagatgtttgggcccttgtttctattttaagtaaacatcttccccattgatcaagagctggactggatttatgaaactaaggttagaattagatttgttttgcgatctggggttagaaaatctaaattgtgaaaaatctcacctaccacaagatttagaaatcttgatttaaattgccaagaatgagacatcaaataatacattgtgaagacaaagagcaagcaaactttgttgttctgaagaaattaatattttttaacattatgtaaccataactcaaagtgatgtgtaacattagaagtgagtaaagattcattgatgtcagtgcagagagaatatactataacaatgagtataacaattttagaaaacttacttagtttatttgcctccaagaggctcagaagagtttgaatataatgatttcctcattttttcaaatataaaatgaagtttcacttaaaatttctccatttcagctttaagattacttgattttatagtctctgaattctataatttgcatattaatatttttgatctaatgttaaaaagcaaaagagatgacaatcaaatgctaacgactatgaggtttctgaaagctggggttattatcaaagtacacttccactggggaaaaaatgacaacataaaactcattgtcttcataaatgaatctttattaatgctgtcaggtcttaacaaatgagagtgtgacactaataggattaagtaacttttgacttcattactattatcagagtcttggttagtgttcatcgtccactaatgccttttgttaaatacatctgttattaaaaatcccacagtatggatggacacttatggaacgtaagttggacatcgtaaatagttcaattctggaatttataaattgaggctctgaagaacaaatgtgttcccaaatctgagtgatctactcacatcatgcctcttaacttaatattaccaactaactataagaagcaccactaaattttatgttattagatacagatgtattgatctgttatttcattgtccactgtatctaaataaaaataaatttgaacttaatattattcttgccaaaggaaatgacttaaatcctaaaataaaaacatatttttataagacaaaattaattggtatagaattatttaatgaaaacatgaggttgtattacacagatctaattgtctttaacaattttgatcaatgctaataatctaagattataaatatcccaatgtgggtagttttcttggcataaattattctttttgtctacactgatttatattgattatataacaacactgctgtggagacactctcttagtgaactgaagtgtgatctttcaatcttagataaaataaattgatggattggtaagatttctgtatcagaggtgatgacaccttgtatgagaagtgatgataaaagcaataaggtcattctgcagaaaactttctgagtttgtttgagttttatctataaaataatgtatctatcttcatgattttaccagggtatgagtttggaccagtttttgatggaattggtctttagcaaaaactataaagtgcagatgaaaactaattctcacttaaaaatcaaatactgaagaaattaatattctcccttttgtatttatcagtgtacagtcatcttcacaaaactaatcaagaatgaataattaaataatctagtagcctaatagaccaaataaattgctttgaccacaaattaaattttagcagattgttgttcaagtgtctttcaatttcccagtgcaggtagatgtcactggaggaaggaaaatattgagtctaatttaattaaataacgcagaacttaattttcttaattatttttgaaatgtccttttttcattggtcttttgcttgcacaaattatatcttcaccaatctattctacaaataggtaataaagtgttttatccataaaatgttaaatatctattactagagcactaagggcatcaaaatagaatacatgtggacacacactttttagcaattaaaactataaaaatatcgctagttatctattttgtatttcctttgaaatagaagaggtacttctaggtgaacaatcataagaaacctattgcttattctttatacattggaagagtatttagtggtagcatgttttaattgctgcatgcacatatctctatacttgctggtaaactgaggaaagtagtataacgtcatatataggaaacatattttaaaagacatattttgcaaagtaagtgtgaattttgtttcattaagcaaaacaaaggattttaaaagttgaaaatcataaaatgaagttttggattttctaacctaatttacatttgtctttgcgatctcacttaatctggaattttattttatgtagagtattatcatgaatatttctcatccttttacttattttatatatagaatttcattattttaagcttcttcaatacaatgaagtgaaattctaaagaatgaaaggctgttctattaaattttgtctagatgtaacaactgactgctaactaatatcttagtctaattccagtaatctaaatttaacacatatttaatgagtgctcaatgtacaaagtcttgagggataaaaaatgtgtttggaaaacagtcagtgtccccaaggagattaataacaggcattatcaggattatatttttgctctaatgatagtaaagaggaaagaatatttattttatatatacatacatacttatgtgtgtgtgtgtgtgtgtgtgtgtgtgtgtgtgtgtgtatcttttttctttctttttctttgtgagacacagccttgctctgtcgcccaggctagagtgcagtggcacgatctcggcttactgcaacctccacctcctgagttcaattgattctcctaccttagcctcccgagtagctgggactacagacgtctgccacaaagcttggctaattttgttgttgttattgtatttttagtagagacagggtttcaccattttggccaggggctcaaactcctgacctccagtgatcctcctgcctcggcctcctgaaatgtcatggttacaggcatgagccatcacacttggccatatttattatgttataagaacattttatcttaaattaatcatgctgccattaagaaaatggaattatttaaagttttattgtctcagaaaagttaaaattttatatctatttttagtagatttttaccaagcactctcattaacttatgatatcttattttgttactaggtttgcaattatggcagttaatactttttgccaacatttatctgcacaatcattttgagactggaaataaaaccttttgatgacaatggtaattcttgtgctagttgtggtaattacctaagtctttctattatcttaattctcaaacttgttatctgtgcctacaattcctctcctatataatagagaaaattaaaattatccttatgtagcatgcagggatattataaaagctaatgatgtaagtaaaatctataaagtttgctgagtaccctgaagaaaactgttctgtaaacaatagttatgggttttactctgtaggttgaggttaattacagtctttcacaatttttctaagagttgatgcttcatactccttaaaaagcctattttacgacttaaacttagttttccatacatgttttatgtatgtatacagagaaaaatatgacaacattaatctatttcttgatcagtgccactggctctacatttttttctggacctagttcagtttttgttttgttttgttttgttttaagtcttccacttaccctctttggcttatctcttgaatcaaatgtctcctcttcatttgtctttgtctcctcgtggccctccatatgacagtgatactgctaatatgagtactttctcatatactgcctctaccatctggaattgctttatttacatctcattcatatgcccttatttttttaaaaaagatttcctctcttgtcttttgttttttcaagctgagaacttattttcctatcccctttctaagacaatcacgactgttttttttttccagtagattttgtagaacaggtgtgtaataacatacttgaacttttttatttttaattattctaaattaaataggtcttaaaatatcctttttcaagcagaagatttgctataacaagcctttcctggatgctagtatgtttttctggcttataagagagccaagatatcctctgaggacaagagttgtttagaagaattcatttaaaatagtttgaccagggaaatatagcagaataaacagcctgcatcctaaggacagtggaacaaggggagcattgctgtcagtaatgcaaataacaaagtaaatggttaacagaagaacgaagttgtgttctagataatcatatactgcctctacggtctggatgcatgaattctagagaaacaatttaatggactataaataaattaagaagtttaagactttatggattacttttagttgaacagagtgctttatttaagtcactgaatgattatatggatgaattttagattgcgtatagatatcaaaaagccaaagaatatgatcatgcttagttacaaactaatgcatattcaattaactcattaaactaccttcaataaataagtaaatataaaatgaaggctacttacattgtttgaatacacaatataataagattctgatgctgattatttgattttgtgtttagtggtttcatactgctttggcttggaggatgtaagtatttaacagatcctgtgtgtttcaggaggcatttaaatcttttaattttgctgtgaggaaagttattcctaagggatcagtcacagatagctatattacccccatcaaatgcatcattttcctagattccaaaccctatgtagaaatctccaagttgaagaagtaacaatgaccatgctatcaatgtttaatcctttggaaaccatagtaatggtataggaatgcacctttttaactagaagtactcatgggcctggaaaagtgaagatgacctcattggggaatggatatatggccctaaattggaaagtcattggctggcttctgtataggctatttatagcccatttattcatctgcagcttttaagattctaaacatttctctataatctattttccctatagttagaggttaattatactctgtttatctatatgtttaagatcaattacctaactgctaaaatgaaagcattttcatatagctagagctctcacacagaaaactagtttacgtgtaaggtaaccagtttaataaaactgataatctctttagctcttagaaattggattttaattatttatctaatagacaagacttcttaagctatattttctactcaaatatactaatggaaatgtaagtaatttaaaatttttctccaactgttttgtggatgttttgtaaattgtaatctcattgtaactatgtctggtgttctacaatctagactataaaggtgtgaagcaaaaaaaaaatgatttctttctgaaataatgttttacattactattttacaccacaaaatagtgactggccttattttaggtattgattaatgtaaaaaatggcattttacccaataaccttcctgttattaccaggcaactatggaatttagtgacacaattatttttgtttctttttttcatcttaaggaacaagttcttaattagattagatacagctataagtaaacataaactatgttcttatgtaacctcaagagttattttaggccgggcgcggtggctcatgcctgtaatcacagcactttcggaggccgtggcgggcggatcacgaggtcaggagattgagaccatcctggctaacatggtgaaaccaagtctctactaaaaatacaaaaaaattagccgggcgtggtcgcgggctcctgtagtcccagctactccggaggctgaggcaggagaacagcgtgaacccgggaggcggagcttgaagtgagcccagatcgcgccactgcactccagcctgggcgacagagtaagactccatctcaaaaaaaaaaaaaagaaaaaagttattttaaagtgtctccatgccttgttacacagttcattgacaattgtttaatctgttgctgctgttaagtttccttaaatttgtgattatttcaatgagttagtgatagtttattcacccatatttgtggtgcattgccacaaggaattattgacacttctttttactgacaacagcttttttgttttgtgtttacagtgtgatgttgagagttttgttgtttcctcacaaataactgactgcataactctatgctttcctacatggttagcaattgctatttcatgaataattggatttgctttcctagttgcagttatcagtcggtgcttcttaaaaagatagctgtttattttgatgactgcttaggcaatatttattattaagtattgctttctcaaatgatttttcacagaggcagtggacaaatggtttgacctgtacagtgtacagtgtacaaagattcattttgtagcttaaagaatgaattatctttgtgtcctttgtgtgtgtgtgtgtgtgtgtattatagagacagggtctcacagtgttgcccaggctggagtgtagtggctttgcacaggcacaatcatggcatgctacagccttgaactcctgggctcaatcaattcccctgcctcagcctccttagaagctgagactacaggctagcactaccaggcccaacgttttttgtacattttttaatatgtattttatcctcttatgaatttttgttatctatttgccctgtataatattaggatgggtatatcatttatcctccaaattaagattaaacagggacattaaattaaattaaacagggacaaccagaatatatagtcacaatatttaaaaccccaaatttctacagtaattccttcttttccattttacatccttcttctgaaggtctcgtctaccttgagccagagagctgccatcttctgcaaaacatcattggggtcaactattacttgcacaaacttgaacttcactctgttttaatttagcagagcgactctcaggctgacttggttctgttggcaaaagactagcttctgaagaattgtctaacagcagaaacgctgtcatcaagcttacatagggtgaatttttttctgagctggcattgttcatctaatgtagtgttttctaaagctaaattttacacacacaaaaaaaacagacatggaaaacaggcataattgcatttagaattatgttacttttggacataagatttctatttcctttgatattattcaaataggtgaagactatgtcgtttgcttctatgcactgatccacaaaatgtaggaggtattaaatgtcttgccaagttactaaacaagtaaagttttcagaagctcaatgtgtgaccgagtttctccttttctacacatatttccctaaatagccatttgtctacaggccatgtgagtatagcctgaagacaggatgagatacagagccacttaagcagctttccaaaatgaggttttagattgtggagccaaagctctgagtggtttttgtaagagaggaattttttttttgttttttttttttcttgagacagagtctcgctgttgcccaggctgaagtgcaatgatgcgatctcggctcactgcagactccgccccatgggggttcactctattctcctgccccagcctcccgagtagctgggactacaggcacattctttatgactgtatctccatggacatattcttcataaatatttagaacagcttatactgtcttctattatactggcttgaagataattgataccattgatgcaggatcaagtgttgtctgtctttgttcatctacattacaaaacatggtgtcaccaataatctaattatttttgttatactttcctgtgttactggtttgaagataatcgataccattgatttgggatcaaatttgtattttgctgtttgtctccattcatcaacaatacaaaatgtgctgtcacccataatagtttatttttgcatcatatgttttggatttctacattcatttgcctgaatttttcactcagggttttggatattatatatttcatatgcagcatgtatcatttgatggtgacttaaatgcctgtatcctattataacagaactaatcacttttctaaagataagtataagtttggtccacaaaaaaatttctacgtacattgactcattgaacctgctacgatgaagacttctactttacaattcaactatgcatatcaggattactgatttctttatatgacattacttatgaaaagaagtaattttatgaattactaaacactttccaagtatgtttattttgaaacttgcctttaattaatagagatagcttgaatatttagcatagtccctaataaaaataattgaattaaatttaagtatctagtcaatagaattaatagcaattgctataaacctaaataattatggtgataataaaaatcaagttaaatacaagatgtggtatagagttcagttagcttaataatctaatgttttactagtccacattcaattttagagtaatgatgttgaaaatgcaaattacttattattaggttccttaactttactatttacttactttttagtttttttaaagttttattttaggtttaggagtacatgtgcaggtttgttatataggtaaactcctgtcttgggggtttattgtacagattaattcatcacccaggtactaagacaggtaagtacccaatagttatttttttctgctcttctctctcctctcaccctccaccctaaagtaggcccaatatctgttgttcccttctttgtgtccatgagttatctttatattaattatttttatttcactacttggcagtttgccaaatcagaaacttgattttgataagagaaaaatgtctatttcagaagttaaaaatccgtatttaccaaatgtttaccagtctactatcattgatagggttcactatatttcaatatatatatcccagtgttgtcaaatttttgaggtattgtgattttattagtgtttgataatgaaaacataacttcaaagtctattacctgagcattgctttaatatccaggattctttgtacatgccattatgttcctgaaagtacatttagcataatatgtatagctaatttatttgaaaacatagccaattcttcattattcagaagttaataatcaaatttcatgaatcatatccctccccactacatcctactacatttcattttccttcaaaatactttaaaaatacttcctagaaattatctactttagcaaatgcatttcaagattctcagaaaatattttttaatagtccagaattattcataggattagataagctcaaatctccattagatgttcttttctgttattagtaaactcccctctttagtttagttcagtgttgtagcacccttattcttggtttctattacatttagagtatcttacaaggagcagcatctgttactcttctaagagattaagtcaaaccaaataggtgtgtctatttagaataatagggatttttaagagaattataattggatcttgtaggtgtcacaaacctcagtgtaataggcatcattgataagagattcctcttttaactgtttattttggcattgctacattcgttttgaagattttcttggtagccttgcatacattttaaaccatttttcttacaattagatgctgtgataacatatagaggctgtggatacctacaattttaacttctgctttgattcccagaaggaaagtataaatattatactggctctgatatattagaactttacattaatttttagacaagataaaaagtatttttaaaatattttctaccatattgctcaattatcatccttttatcatagcaacttatcaatgttacaaaacgtttttgtgggcattatagtttggaactcaattttgagaacattgtcttaaaaatcttatcaagatatgactttccaaatacaacatttgtattacaattagatgtataccttgttcttttttcacttttaaattaaaacatgtggctgctcacggattgaaaacaggtttacctatatatgtccttaccaattggtaagcattattcaaagtagatcataaaaaggagacaaaagccttgatattcccaattaaaaagatttaaactaaaaactccttctgctaactgtatactgttgaagcatttattgtataacccttaactgtcaagaactgccacatcttttgatatttgtgacagctattttaggagaataagggagatgcaatgttataataggtaagggatgaagatcagcttcctggtagattacaaagtagtgataattctgctttcatcctattgtgttttttttctgcactatagattgaattacatattattgctcaatgtgatgctgattaattaagatgtagggagctgtggaaaattatccatattttgtcataaacatgtttactgactgtacatcagaaaatcactaaataatgcatgaaattataaaaattacattaaaatattaaaattacctgtaaaacctaggtatttaaaccactgtagtttttcatatgatattgtcagatcaaatacacttgccactttcatttaagaaataattaccaatattagatgtaacttaaacataaaataaaaagagttggacatttattcatatcaaataaatagactaatgtcttctatggatacgtactcttttccatatttttagttgttcttcttccatttttaatttttatgagtacatagtaggtgtacgtatttgtggggtacatgagatattttgatgcagtcatacaatgtgtaataatcacatcagggtaaatggggtgtcctcagttctttgtcacctgtggttttagctctgattaagaacttgtcttggaacctaagtcaaagtttgattttaaatttttcgttgaaattgacaggtcggctgaggaaatgaagatttctccagttctgtagtcaggtggtctgatcgttagactaattggatttacataaacccaagtattatattttacatatgcattgatttttatcacctctattttcaagctgttgtataaatgttgcagctttcaggccctacttccattggtaacaaatagaaactggtttgctgctattctgtcctggcatacaaataatctaagtcaaaagctttgcttttcatgtttttctaggatagtgagaggaaaaaaaaaatttctcctactcaaagcatttatttcatttctattttcataaaattaggaattctttttttttttttttcttttttgagacggagtttcactcttgttgcccaggctggagtgcaatggcacgatctcggctcactacaacctccgcctcccgggttcaagcaattctcctgccttagcctcctgagtagctgggcttacaggcgcccaccaccgcactcagctaatttcttgtatttttagtagagacggggtttcaccatgttggccaggctggtctagaacttctgacctcaggtgatcctcccgcctcggcctcccaaagtgctgggattacaggcatgagctaccatgcccagcccaaaattaggtattatttgttaatgacttacgggtttttaattagccacaagatacgaaagtctaaacaaaagtatgttttgttatagtcagtttaatgccctaaaaaaatgatgtttgcacaaatgattctaatgcacaaatgttattagtttctatacatttatattttctcagagtcttttctgattatttgctggaccctacatttataattccatttatgccgatttcagagtaaaatttctattggggtacaatttagtctttttcttctaggattgcaattttcattgtgttggcctagggcttctcaaccttggcattattgacatttgaagctagataattcttccttgtggggtggtgtgagagctgtcttatgcactgcaggaagtttggcagcatctctggcctctaccaaatagatcttagtggcactctcttgcccaattgtgacaagcaaaaatgtctccagagtttgacaaatgttttctcgggttgcggtgggggccccaggaatttcaacaatagaaaaccattgctttagctcacccttacacatattcataagagaggattttgtattttatagaaagattttattaactccaaaaaggagtcagacttgaaaaccttcaaaaaccttcaaatgatgagcattctcagataaaatatttcagaaatgttgaaacaataaatgctatttgaataacacatactttagtggtcataggtgaaatagtattaggacatatatcaagtcctttgataaaaagatattttatgaagtaatagtgccttttaacaaattcataatatgttataatttatcgtaaatgtagaagttactttcttatctgtgtgactgaaggggaacacagtgctaaatgataaaacagagtagcctgaggtggttttcttctaatttcaggtcagatttacatttcactaattgcacaaaagtttttcaatattaattttgttttatatatacagaaaacatatttattattagcactagcaaaatcttatgtaatgaacccacttcataaatagaatatttatgttaatcaaatatgaatgttttgccaacctaatttcaaatcttaacataaaaaattggaatgagaaaattgatacatatgagtatattggtatatgtattataaatgattcaacctcagctagtaaaggaagttttattattttcaatagtaaaatcattatttttctaatttgatttcatagttatgtaagaattattagcaattttaaaataataaactttgagcgaaactatttcctgattgttaatggataagaaaaagataaaaattgacatctagaattaggcaaaggaaaaactaatggaagattcaatatatgaatgagacacaaaagttgatagtggtgtgtgatagaactaattacaagcgttttttaagcgaatatttttagttatagatttatttatgaaaaattgttcttagctcttgaattttatagtgtttttaaatttttaatgtatttacttttttcttttttcttttttctttttaatttttgttagtacatcataggtgtatatattcatggggtacatgaaatactttgatacagacatgcaattgtcatgatcacatcgtggtaaatgggacatccattccctcaagcatttatcctttgtgttacacacaatccaatgatacttttagttattttaaaatatatgattaaattattattgactgtagccaccctgttgtgttagcaaacgctaggtcttattcattctttcttttttggtacccattaatcatccctacctcccctgcctaccaacaacccttgctagcctctggtaaccaccttctactctctgtcttcatgagttcaattgctgaaatttttagctcccacaaatatgtgagaacgtgtgaagtttctctttctgtgcctggcctacttcaattaacataatgatccatccatccatgttgttgcaaatgacaggctctcattctcttttctgaatagtactccattttgtatatgtaccagatttcctttacccattcatctgttgatgaacacttcagttgcttccaaatcttggctactgtgaatagtgctgcaaaaaagcctgggagtgcagatatcactttgatatacttatctcctttcttttgtgcgtatacccagcaatgggattgctggattgtaatggtagctcaattcttagttttttgaggaacctccaaactgttctccaagtgattgtactaatttacattcccacaaacactgtacaaggattcccttttctccacatcgttgccaacatttgttaccacccgtcttttagataaaagccagggggtgagataatatcttattgtagttttgatttgcatttctctgatgattaattatgtcaaacatcttttcatatgcctgtttgccatttgtatatcttatttcgagaaatgcctattcaaatcttttgcccattttttattacaatattagatttctttttctctagagtgatttgagctctccatatattcagattattaatcctttgtcagatgggtagtttgcaatattttctcccattctgtgggttgtctcttcactttgtttttgattgtgtcctttgctgtgcagaagctttgtaacttgatgtgatcccatttgcccatttttgctttggttgcctgtgcttgtgaggtattgctcaagaaatctttgcccagaccaacatcctggagattgtttccaatgttttcttgtatggtataatagcttgagatcttaaatttaagtatttactccaatttgatttgatttttctatatggtgagagataggggtttaatttcattcatctgcatgtggatatcaggtttttccagcaccatttattgaagagattgtattttccccaatgtatgtttttggcaaccttgtcaaacattatttcactgtagtagtgaggatttgtttctgggttatctgttctgttccattggtatatgtgtctgttcttaagccaataccatgctatttggttactatagctctgtagtataatttgaagtcaggtaatgtgattccttcagttttgttctttttgctcaggatagctttgtctatactgggttttttgtgtggttctatacaaatctgaggattttttttctatttctgtgaagaatatcattggaatttttattgggattgcattgaacctgtagattgctttaggtagtatggacattttaacaattttgattcttctaatctatgaacatggaatattttttcccttttttggtgccctcttcaattgctttcatcagtgtttcatagttttcgtgattgagattttttacttctttggataagttaattcctaggtatttaattttttgtgtggctattataaatggaaataatttttaaattctttgtcacattggtcgctgttggcatatagaagtggtattgatttttgtatgttgattttggatcctgcatctttactgaaattgtttatcatttctaatagttttcttgtggagtctttagttttttccaaatataagaccatattatctgtaaacaatgataatttgaattcttcctttccaatttggataacctttatatctttctcttatctgatggctctagctaggactaccagtactatgttgaataatagtggtgacagggggcatccttgtcatgttccagatcttagagggaagaatttccatttttccacatttagtatgatactagctgtggatctttcatatgtgactttaattgtgtttagatatgttccttctatccccagttttttgagagtttttgtcatgaagggatgttgaattttataaaatgctttttcagcatcaattgaaatgatcatatggtttttatccttcattctattgatgatatctcacattgatttgcatatgttgaaccatccttgtttaccaggggtacatcccacttggttatgatgaatgatctttctaatgtattgttgaatttggtttgctagtatttttgttgaggatttttgcattaatagtcatcagagatatttgcttgtagttttctctttttattatcatttttaagttccagggtacatgtgcaggatgtgcagttcattacataggtaaatgtgtgccgtggtgatttgctgcacctatcaacccatcatgtaggtattaaacacagcatgcattagctagttagctgatgctctccttccctaactggcctcagtgtgtggtgttcccctccctgtgtccatgcgttctcgttgttcagatcccacttataagttagaacatgtggtgtttgattttctgttcctgtgttagtttgcggaggataatggcttccatctccacccatgttactgcaaaggacatgatctcatttctttttgtggctgcatagtattccattgtgtatatgtaccaaattttctttatccagtctatcattgattggcatttgcgttgattccacatctttgctattgtgaatagtgctgcaatgaacatacatgtgcatgtatctgtatcgtgcaataatgtatattcccttgggtatatacccagtaatgggattgctgggtcaaatggtatttctggtcctaggttatattagtctgttctcatgctgctaataaagacatacccaagactgggtaatttataaagaaaaatagggttaattgactcacacagttccacgtggctggagaggcctcacaatcatggcacaaggcaaaggaggagaaaggcaggtcttacatggaggctggcaagagagagcgtgtgcaggggagctcctttttatgaaaccatcagatctcatgagacttattcactatcacaagaacagcacaggaaagaaatgcttccatgattcaattacctcacaccaggttcctcccatgacacatgggaattatgggagctgcaatttgaaatttgggtggggacacagcgaaaccatatttttctgcccctggcccctcccagaactcatgtcatcacattttaaagccaatcatagcttcccaactgtcctccaaagtcttaacttatttcaacattaactcaaaagcccaagtccaaagtctcaggtgagataaggcaagccccttccacctatgagcctataaaatcaatagcaagttactttctggatacaatgggtgtacaggcattgggtaaatacacccattccagatgggagaaattggccaaaataaaggggctacaggccccataaaagtctgaaatccaatagggcagtcacatcttaaagttcaaaaatgatctcctttgacaccatgtctcatatccaggtcatgctgatgcaagaggtaggttcccatggtcttgggcagctccacccctgtggctttgcagggtacagcccctctcctggctgatttcataggctggcattgagtgtctgtggcttttccaggcacatggtgtaagttgtcaatggatctaccattctggggtctagatgacagtggccctcttctcacagttccactagatagtgcaccagtggggattctttgtggaggctcccaccccacatttcccttctgccatgcccttgcagaggttctccatgagtgctctgcccctgtagcacacttctgcctggacatccagttgtttccctacatcctctgaaatcttggtggaggttcccaaacctcagttcttgacttctgttcaccctcatgcccaacaccacgtataagccaccaaggcttggggcttccaccctctgaagcaacagcctgagctctacatcggacactttcagccatggctgggatgtaggtcatcaagtccccaaactgcacaaagcagcaaggccctggtcccagctcatgaaacaattatttttttctcctaggcctcccagcttgtgatggatgggagaggctgccatgaaatctgctgacatgtcctggagtcattttcccattgtcttctcgattgatatttggctccttgtttcctatgcaaacttttgcagtcagcttgaatttctcctcagaaaatggctttctcttttcaatcacattgtcagactgcaatttttccaaactttcatgctctgccttccttttaaacataaattccataagttcaaaaccatattgtagtgaatacataacactgaatgcttttgacaataccgaagtcatttcttgaatgctttgctgcttagaaatttcttctgccggataccctaaatcatctctctcaaattcaaagttccacaaatctctagggcagggacaaaatgccaccagtctcttcactaaaacatagcaagagtcacctttgctccagttcccaacaagttcctcatctccatctgagaccacctcagcctggactttattgtccatttcactatcaacattttggtcaaagtcattcaacaagtctctaggaagttccaaactttcccacatcttcttgtttatttaggatccctctaaactgttccagtctctgcctgttactcagttgcaaagtcatttccaaattttggggtatctttacagcagcaccccactctaccagtaccagtttactgtatcagtccattctcacatggctagtacagacatacccgagactgggtaatttataaagaaaaagaggtttaatgaatccacagtttacaacaacagtgtaaaagcttttctatttctccacagcctggccggaatctgtattttgtggacattttaataattgtcattctgactgtcctgagatagtatctcattgtgattttggtttacatttctctagtgatcagtgatgttgagctttttttccatatgttttctggtcgcatgtatatcttcttttgagaattgtctgttcatgtcctttgcccactttttaatgtttttttttcttgtaaatttgtttaagttccttatagattctgtatatgagacctttatcatagggatagattgcaaaaattttctcacattctgtaggttgtttgttcactctgatgattgtttcttttgttgtgcagaagctctttaattagatcccatttgtcaatttttccttttgttgcagttgcatttgacattttcatcatgatgcctttgcccttgcctatgtcctgaatggtattgcctagattttcttctagggtttttatagttttgggctttacatttaattcattcatctatcttgagttaattttggtaaaaggtgtaaggaaggggtccaatttcaattttctgcatatggctagccagttctcccagcaccatttattaaaaaaggaaccctttccccattgcttgttttttttttttcaggtttgtcaaagatcagatggttgtaggtgtgcagtcttatttctgagttctctattctgttgcatttgtctatgtttctgtttttgtagcagtaccatgctattttggttactgtagccttgtagtatagtttgatgtcaggtagtgtgatgcctccagctttgttgttttcgcttggaattgtcttaagtatatagtctcttttttgattctatatgaattttaaaatagtttttttttctaattatgtgaagaatgccaatggtagtttaatgggaataccatctataaattactttgggcagtgtggacattttgacaatattgactcttcctatccatgagcatggtaaggtatatttttccatttgtttgtgtcctctttgatttccttgagcagtcgtttgtagttcttcttgaagaggtctttcatttcccttgttagctgaattcctaggtatttgattctctttgtagcaattttgaattggagttcattcatgatttggctctctgcttatctgttgttggtgtttagggatgcttgtgatttttccacactgattttgtatcctgagactttgctaaagttgcttatcagcttaagaagcttttgggctgagacaatggggttttctagatttaggatcatctcatctgcaaagacaatttgacttcctctatttctatttgagtatattttatttctttctcttgcctgattgtcctggccagaacttccaatactatgttgaataggagtggtgagagagggcatccttgtcttgtgccggttttcaggggagatgcttccagcttttgcccattcaatatgatattggctatgggtttgtcataaatggctcttattattttgagatatgtttcttcgatagctagttcattgagagtttttaacatgaagtgttgttgaattttattgaaggccttttctgtgtctatttagataagcatgaggtttctgtctttagttctgcttatgtgatgaattatgtttatttatttgtgtatgttgaaccagccgtgcatcttgaggataaagctgacttgatcgtggtggataagctttttgatttgctgctggattcagtttgccagtattttattcgggatttttgtattgatgttcattaaagatattggcctgaagtttcattatttatttttatttttttggttgcatctctgcgaggttttggtataagaatgatgctggcctcataaaatgaattagggaggagtccctccttttcagttgtttggaacaatttcagaagaaatggtatcagctcctctttgtacctctggtagaattcagctgtaaatccatctggtcctgggctttgtttttttggtaagctatttattactccttcaatttcataactcattattggtctcttcggggattctatttcttcctggttcagttttgggagggtgtatatttccaggaatttatcgatttcttctagattttctagtttatttgcatagaggtgtttatagtattctctgatggttgtttgtgtttctgtgggtaggtggtgatatcccctttatcatttcagattgtgtctgccccagtgagatcagagttctgtccataaacccctgactggagttgctgatattcctgtagggaggccttgcccagtgaacagggatagatccaggtcccacccaaagaagcaatctggccacagtctgtcacagccactgtgctgcactgtggagaattcctcccagtcgaaaccttccagtctgtcaggccctggcagcagaaaatggctgtttggagccacagggatggctgccgcacctccccccaggaacttggtcatcttagtcagtctccagcctgctacctaccgctgggtccaacccaaacggctgctgagattctgcacaattctgtgcttgggacccaaagtcctggtggcataggctcacaaaggaatctcctaatccctgagttgtgcagatcggttgaaaaagcatgatttcctgagcagagtagcacaataacctcctcccttggctgagggtaggaacttcccttgccctgtgcaactagcagatgggccatcactccaccgtgcttttctctctgcatgggttgcatcaactgcctagtcagtcccaatgtgagaacctggataccttagttgatggtgcaggatgcactagctttttttgttcttcttggtgagagctgccaaccacacctgcatctaatcagctttcttggcaccaccgccactcatcttggccccgccaacacccagttttctttttttgatgtgtcttagtctgatttttgtatctgggtaatgttggtctcatagaatgagtctggaaatattctctcctctattttttgcaatagtttcagtagaattggtattagttcttgtttgaatgtttggtagtattcagcagtaaagctatcgggtcccaggcttttctttactgagaggcttttttattacagctttgatctcactactagttattggcctgttcaggatttgaatttcttcctggtgaaatcttggttggttctatgtgtctaggaatttctctattttcttctaggttttccaatttattggcatatagttgctgatagtagccactaatgagcctttgcatttctgcagtgtcagttgtaaagtctcattttttcatttctgattttatttatttatatcctctctcttttttcttagttcatctggctaacagtttgtcaattttgtttaactattttaaaaagccgctttttgtttcttcaacaatcttttttcattttcttcatttcaatttcattttattctactctaatctttattatttatttccttctactaattttgggtttggcttgttcttgcttttctacttattaagatgaattgttagattctttatttgaaggttttcctcttttttgatgtaggcactaatagctataaacttccctcttggtactgcttttgctctaccccataggttttggtatgctgtgttttctttattatttgtttcaagaaacttttcaatttacctcttaatttctttattgacccactgatcattaagcagcatattatttaatttccgtgtatttgtatagtttccaaaattcctctctttattgatttctaggtttattctattgtgcttagagatgaggcttgatattatttcaattttttgaatgttttaagacttgctttgtgacttaacatatggtctattcttgacaatgatccatgtgctgaggaaaagaatgtgtattctgcagctgttggatgtaatgttctgtaaatatctattagatgcatgtggtgtatagtacagattaagtctgatgtttctttgttgattttctgttgggaagatctgtccagtgctaaaagtggggcattgaagtctctagctattattgtacttgggacaatctctttttagctctaataatattttctttatatatccaggagctccagtgttgggtgcatatatatttaaaattgttgtatcctctgactgaattgaaacctttatcattatatactgactttctctcttcttaattgcttttgtcttgaaatttactctgtttgatataagtatagctacacctgctcttttttgttttccattggcatggaatatctttttctctttttcattttcagtctatgtgtgtcttcataagtgaaatgtgtttctcataagcaacagatcactggttctcattttttcatccatttagccattctttgtcttttaattgaagatgttatttcatttacattgaataatattgataagtaaggacttactcctgccattttattatttgtttcctggttgttttgtggtcttctcttccttctttctgtccttcctgtcttcctctagtgaaggagattttctctggtgaaatgttttagtctcttgcttgtcattttttgtgttttcattttatgttttttggtttgaggttattttgaggcttgcaaataccatcttataatgcagtattttaagctgataatagcttaacattgtttgcataaactgacaatcaaaaagaaaactaataaaaattctacaccttaacttgatccccaagctttttaactttttgttgccgtactgactatgtcttgaaaagtggttgtagttattacttttgattggttcattgtttattctttctacttaggataagagtagtttacacattacagttacagtgttataatattctatgtttttctgtgtacttgctgttaccagtgacttttgtacctccaggtgattacttattgctcgttaatgtctttttctttgtgtttgaagtactccctttagcatttcttgtagggcagatctcgtgttgatgaaatctctcagcttttgtctggggaaatatttatttctccttcatgtttgaaggatattttcaccagatatactattttaaggtaaaagtttattttccttcagcactctaaatatgtcatgccactctcttctgatctgtaagatttacactgagaagcctgcttccagacgtattggagctccattgtgtgtgtgtgtgtgtgtgtgtgtgtttgtgtattttccctctcttgctgtctttaggatcctttctatatcattgatctttaggagtttaattattaattacctgaagtagtctttgcattaaatcttcttggtgtaaaacttccttttactttgatattgatatatttttctaggtttggaaagttctctgttattattcttttgaaaaactttctacccctatctctttctctacctcctctttaaggccagtcactcttagatttgcccttttgaggctactaatatttcttagatcctgtgggcatgcttcgttgttttttattctttgttcttttgtctcctctgtgtattttcaaataccctgtcttcaagctcactaactttttcttttgctagattcattctgccattaaaagactctgacacattcttcagtatatctattgcattatttaacttcagaatttctgcttcattatttttagttatttcaatctctttgttaaatttctctgatagaattttgaattccttctccacattatcttgaatttctttgagtttcttcaacacagctattttgaactctgtttgaaaggttgcatatctctgtttatctaggctttgtcctgggtgacttatttagttcatttggtgcgatcacgttttcctggatggtgttagtgctaatagatgttcttcagtgtttaggcattgaagagttaggtatttattgtactcttcactgtctggaattatttatacccatcctttttgggaatgctttccaggtatttgaaagggctttggtattgtgatctaagctgtatgtgctttagggtacactccaagcccactaacactgtggttcttgcaaactcacagaggcaccacctcaatggtttggacaagatccaagggaattctctgtattaccaggcagagactgttgttctgttcccttatttttctcaagcagagtccctctctgttctgagccacctaaggttggggatatggtaacacaagcaccactgtggctttcaccactatgactgcacctggtcagacctaaagccagctcagcactgggtctcacccaagttcaagctcagcactgggtctcacccttgttcaaggacctgtggctctacagtcagccagtggcaaagccagccaggtctatgtctttcatttcagggtaacaaggtctctctgggaccaggtgggtacagaggtgccatctggaagtgagggactacagtcaaaaaccttagaagtctccctgctgttctattgtaccgcgactgagttggcactcaaaccacaacatgcaatccttcccttgcttccctgtactttccaaaggcagagaagcctcatcctgtagccactgccaccccaggccacaaggagtcctgccaaactactgctgatattcccttaagacccaaaggctcttaagtcagcttgtggtgattgctgcctggcatgggactcacccttcagggtaatgggctcccctctgttccagcacaggtccagaaatgctacccaagggtcgtgtcctggaattgaggaccccaaaagcccacttggtgctctgctcccctgttgccatgctggtacctgaagccagctgtctagaaatgtcatctgggagctagggcctggaatgggggcctcatgactctatccagtgccttatcctgctgtggctgagctggtatccgggatgtaaaagagagacctcctcactcttacctctcctttccctaagtagaagaaaggtgtctcttttggagccatgaactgtgcagccttgggttaggggacaggggatgcttccccagctgatgtctcagtatgctgcatgccaccctagtccactgtcctatgcccagttctgccttaggccttgcctaagagttgtagtccttatggtctaggctgccttttaagtttacttagagacctagagcactttggcccttggtggcaaggtttgtgagaattcaaatttggaccactgggatcagtggttccccaccagatagggctggtttaaatgctccctctgtgggcgattgtcagctgcgtttggtctggtatttctttctgctctaacagaacagcactgagttcaatggctcacaattgctgtattcttcctcccccagtgcccagagaagctctctgtaccatgaggccactgcagcagttgggggaggagaagtggcttcggtgattcaactttttttttttcttttaatctcttcagtgcctcttttggggtatgaggttcaaactaagtactatgagtgctcacctgattttttcattcctatgaaggtgttttttctttgtagatagatgttaaatttgtgtccttgtggggaggatgatcaatggaagcttctattctgccatcttgctctgtctttcattatagtattttttttcttttagtattgtggcatatgaaaaaatatttctgaccaaccacccataatcatttttatctaaactgctatcagtcattaaaaatgtctgtgtttcattgagcaaaactgggaccagtgtctttaagcttgtcacttgctgggtctgtaaagaattggttagttggatattaatggaaattttagttattcgaatgacttacatagttgctgaatattgtgccataaaatactggttctgactttcaatacatcattttaattaattttggtgtaatttcatacatgttattaatctctggatggaggttagagattatattgtattgatgccctgattaaagtgtgttatattcactgcacttgaagaaaaaaatcactagtagtacaaaaatatcattgtttctcttaattcaacttgatcccaaacataacttaaatcactcctagcttcgttgctatggggcatagtatcttaactagaaatattaaatacttctagtaaatttgagtaggtaaagactccctaaatatataaacagtagttatgcttacagaaaattggtggcatttttcctatcaatgagttgttttaagatgagtcagagctaatgaagagtcagaaatcatctcagaagacatggtactttcttctaaaacaaaaacagaaactattaggacaaatggcaatgaattctgcctccccctaaattaaagcaggaaagtatgagtcagaggtaaggcccttttaacatctccagatatatcccatggtgtcaggccaactggatagaccttataaatggacttacctgaagctttctttagcccctctgtgcatggcctcgtattttctgccctaaacttttctctttttacttcagttatcacttatcccggatacatatcacgactatcccatactccccattccttgactagtcttacctccaacaaagaagaatatgcactttagttaaaatccagatttataaaaaaagacacgtctatgattcccagtcctttgcctccactgggaaaaaattttttgatctgtttgaaatgttcaagggaaaaaagacccaagtttgctgcctctcccatgccatccttcagcttcacagccctgcctgtggaggtttgattctacttgggctacatcctacttctcaaaaaccaggtcactgagaaatctgggactttcattcatatatgtgtccaatgttttagtgaccaaaaataacaacaacaaaaaatctaccacaagattctgtcattcacccactatagcattaatgacttccaattattcaccaaggacttgattagaatgagccatctctgactagttactgccaatttgaaagtatttacattaaagagcaaaagatacgaactattcttacaatgcttacccatttccaaaagaatgtgatccacagacaaatttgtcatttaccaaacttctctcaccaaaatttgccaccatctttattatgacgtccatttaatcaatagtcagaggccatgggacacagaagaaatggccttctcatgtgatagagaaactgaaatcttcttttggagaaaaggagatttctggactttgatgatagtagatccaaaagaaactggttgaggtcttttatcaatttagaaggtagaaccaatcagagttagaagcactcaagaagccctgagacttaaaagataaaacaccttcatatgatcttaaatttttagcactattttcccttcttgaagttgtattattactgacttcctttacctgaggttttctctgacatacaatgaaccagaagcaactttagttttattttcctgatattaataagcaatcagttaggtttacagcagtgtctattagtgaaagatcatattttcatttttgattactgatttttttaaagtttaacctaatcacaagttttcattaaaatttaccattagatcattaccctgcttctttaaaacaatagttcagataaagtacacctgcaacataaaaagcttttggacttttcttagaatgttcttaaaggacctttttacaagaaatttttaagaaaatcttctaagaaatgtaaaatactttataccagctattgaagaatagtaacggtgaattttgttttgagaacctgactcaatttatacatagaaataatagcactcaatatttattcatattcttaaatgagcaagttaaaattgtatttaattatatactcttaaaattttagatggtatttctttggtttcttttttcaataaacattacttttaggggtggtagttttgaagggagcagggaagaaatctttttatcagtagctcaatattctgggatcagaaaacacaatagtttttgttttgtttttgctctttttgggcagtaattacctgataagtttctcatactgagagctctccagaatacagagttcttgccagcatcaaaaggacttccttttgagaagtaaccatatttcagtgaaaaaatcattgaactaaaaactaagagacttggctttcaaatcgggttctgcaataaaccagctgtgtgatcacgggcaagtcacctaaccttactgtgtcttagtgtccttttcataagaggagaagtaaggctagatgatatctgaagtctgttctagtactagtattcagtggttgaatatactatatttttgttatgaatgcagctcatctaacttaagcacaagagagcagctgctaaaaagagctgattagcaacaattaggagtggcatttcatttgtattgcatatcttcccaattaaaagcatttagtgattaaaattacatgcttgaaatacagtctttaaaaggaaatattttcaaataaatgaaatctctgggtcaaggccaatttgtattttaaacatttgcataatattaaagagttttgctgtagtataaggcatgcttagccattgcagtttttagaatctgaagcgagacagagatagagtcaaagagcgagatagagaatgcaagtgcacgtgtgagcacaagcaaatgaaacaagtaaaaaagagaattctgaattattatgcatgctagtaaaaaatgattggttcctcctaggatgtttacagaattaatcagattatgtcttgtgtttcatttctatacttcacattaagtcatatgtttaagattttcctttatttctgaaagccaaaagctgacttttcaaaatcaagggaagaatagactaaaaaaaatggacctgaaaaatagatgtgcttcactgttctcgtggatataacaaccctgatgtcttcaattaaatctcctttgttccagcttaaaacattgtgaatttaaattaacactttaagacatttcaatctgagtgcacattccaaataacgtaataaaatcatctgattgttctctcagatggagaaaccagagtagtgatagtgaacacaaggccagaaaaaatgaaatggtatttattatatattttcttataaaaacaaagttgggggaagtacacattaaaacagaacttagtacaaaaattctatcattttcaagaatcttcctgagtgcctactcttttgtcaaaagggaaaaacaaagactgttcttaattttgaaatctgacacaatagggaaaaaaaaatcaatgacagaaattcctattctttggactaacatttaaaaaaaagaaccacatgctatgaatagtactgttctacaaaataggttttgctaagtcctagtgggaaaaaaaatacatgtataatatcttaaaccttgtatgtggctttatcaaaattaacaatactattattaatattttaatgtaaacttatttcttcctaagagacatagtgttttcttacccaaagggagatggtgttttcttacccaaagagagatggtgttttcttacccaaagagagatggtgttttcttacccaaagggagatggtgttttcttacccaaagagagatggtgttttcttacacatcactctcctttccttagtatgactttaaagtagcgagggacttggtgacattagggttatcggcagatatgtgactaacggcttgggacattttattgtaatccgttttttattgtatttcccttgacaaggctacaaatgaattctgaaataaatgttctagaagtagtgcatagactctaaaaggtaccacagtattgaatatataagcaacagttgcttttccccctaatagttttagacagcctatagcaaaccaagaatttttagtggaatgaaagtgaatttatgataatacttattatatctgtattgagaatattcaatgtgtattaaagtatttccttaatgttttctaaaacagccatgttattgtagtgttatccatttgaatctatgttcttgcattcctgtggcccaaagatgtatcagtaatactaagagaaaagtgaaaaaaaattaaatatcaggttagttattgataaatcaagcagtggtgaaagtcagaaataaattttgagtctttccaccagcattcctcgatctaaagagtaaatggcttttaatcagttttagaactagatctctttggaactatttttagtacttactggcactgtatgcattttctgggcaactgtaccagatttatagctctaaaagtgctgtgttatttattgccttccaataggcaatgaagtggtgtcttgcacatgcatgtgtcaaaaatgttaaagttttctccagttgtctcgttaattctttcccaggacaatagacaaaatatatggctctctatttggcaatgaatatcctttatcaattttttaaaagaaaaaaaaaacttctcttgcaaatttcacatccaacgtcaactttctcttttttgattttacaaatctccacaaagaattaaagtctcagaagggctttatcttgcttatttcagcagtttttgtcttgggtttgcaatcctaaagtttatttttgaatttaggaagaaatatcactcacaaatgaaggttattaggatgaggttattagaaagtccatgcatttttcatgacctcaacctgaattggcacttttgtatactagagatcaatgccatttcagatatcagaatccaaaaatcaacatatcatgtgtaaattattcttgcatgcagttcttatatattattttcttccctgatttttgttttctttgttgatcacacgtatccatgtttgacagatgtagggttttgcatcttttcaataatgcactggctacataccacacttagtatttgtcataatttattctgaaaatcaagttttacaactaggttgtaaaattttactagcaattgacactttggcttttattacatttttgaacagaaaagaagtagttgtttcaggaaataattttgaaattgttttctggacagttttattaaaataaaagacaaaaaaaaaaacccaagtcaacaattatagagtattcctgtgcctatacagactgagaattaagaacaaccaaattctgctcttcttttatcttttaaaataagagccactactttaattcatgcatttatttatctaacaaatgttttctgaatgtgttcacatatgccaggtgctatatctttagagattatacatttaaacaaagcttcatgccatattaccctacactcacattatttagtatatgaaggcgtacctagagatatacacatagagagtttgcccctatacacagaaataaataattttaagtggatttggaattcagggtagtgcaggtcaattcttccaaacttttaacttttttgtatataaggatgtgtcggtgctgaagatagggagatgatgaattaaggagccatacgttttatcttctttttcatttttctcactgtcctcctgtcatggtcaaacatatggcaaaaggcttcagttttttaattgctcatgtggatgtgagctcagttgaactaactacatttggggtaggactgatgttggattcatgtgttagttattctttattcctgaaggagattgaacagaaaacagtcttggaatcatcattcagtaataatagtaagctcatgttggcactatactttgacgtcaacttagatatctcaccaaaattttgttgaaaattatttatgtcttaacctgtgggcaactcctgttcaaatcccgtggacaatattaagtttaaatatgtttgctcagcaagtctttgtagaactctaaaaatctggaaaaatgggggttatgcatgcaatcacctggctaatcatagattctttttaaagaaaaacatgatgtcttaggatagtacagttcaatagaatttgtgcaataatgaaaatgttctacatctgcagtgtccaacgtagtagctactggccacatggagctgttgagaacttaaaatatgggtagtgcaagtaggaactgatgttttaaattaatctaattcatttaatttaaatctaaatttaaatgctcctttggggctaattaccatcatattgaacagagtagttgtgaaagacagaatagcaatggtgacattatccattaactaatatgtacatttcattatcaccttgagaattagaaaaatatatttttaagattattgccatttcacataaagtaattaaaagacagtgagtatgctgatcttggatttttcatctgacacaagcttgccttaatttgctttggaaagcaaaggccaactcaaaattcagacaaacacataaaagtaaaaactaaatatataaacaagaaatgcacaaacataaatacataaattttaaaattaaaacttacatattcgttttcccagatgtattgtattcataaattggataattggctccgaaacttaagaactttggaacattttccttgttctttttatattatattatctttgtttctgtttatgcaacctctaataataacttacaatttccccatatagctcttattaaaaatgtagtgattctcttaatgtaaatccgttagtgtcaataccatcattaaatccatagttattgatttttctttcaccttaactagaacttaccttttatcacattagtaaaatatgtttactcaccaccatgaccttggcatctaggagaatgctctcactatattagccactcagtattggaatgtcaaggattaaaagaatagtattaagtgccatggattttatgaagtacaatttagaaactattttttctacccataaatagacattttggatttgaaccttcctaaaaacctcttggaatatcattacaaaaattaaattatcattaatcactaaatttgtttagatcaaattataatagtatgttatggtatttacttacattcaatgttgtcatgaaattctattttttcttaaaatatgcagtatatcaaataatagattttgcttgctaattttcaaatataaatacgtataacatgaaaatgtttttcttactatataatcaaggaaaagccaggttgattattgctctgagtaaaataggaatagaatgctcacgtttattgtatgaattaaaaacaaaataactaatatactttggttagctcttgtgaaatttttttttaaataacgttggaacaaactaatgattttaattaatatttctgaaatgccatcttaaattttgtaataaacatctaattcctccacaaagatatattatggcactgcatttgaataaaagtataagtgaatctcagcacccccccaaaatctgaaagtttgcagaaatatcttcaagtaattcataagaggaaaaaatgagatgcatttggatattgtttaagactatatataggcaattataagacaggtaaattttttaaagataatgtgattgaaatacatttataaactgatcatatattctagcagtctctgaaaacctggtattatttattaggttctaatttttaggatcttgttttagacagtggtatgacaaaactataacctcagatcttatcctgttcttttatgatacagcacataaatgagagatcaataaccaatccatgccacttgtccagaacatgtatgttaaaaatgtagtagagaattaaaaattatttagatgtacatatgtgtatgtgtgtgtgtgtgtatatatctgttcataaatcacccatgaataggaatcttaaagtcctcctccgatcttttcttcataccctccagtacctttttatctcattcatctctgtcataatgctgcaagtaacactggacaggaatcttcctctctcatttctcctcggtaagctggcaagatcactacgtttgtgtgtagggatcatcttattgtagtacagggaggggattttttttttttttttttttttttgagacgagtctcactctgtcgcccaggctggagtgcagtggcgccatctcggctcactgcaagctccgcctctggggttcatgccattctcctgcctcagcctcctgagcagctgggaccacaggcgcccgccaccacgccaggctaatttttttttttttgtattttttaagtagagacggggtttccccgtgttagccaggatggtctcgatctcctgacctcgtgatccgcccgcctcggcctcccaaagtgctggaattacaggcgtgagccaccgctcccggccgaggggattgttttttaaatattcccatactgtgacttcgtgggcatgaattgaaaataggtcctatccgaagctacctttttcaatttgaggtcttgacctgtgaattttagttcattgtgcttgcatgttaaaaaaaaaacagtaagaaaataacattgcattgttaatctctgagataatttcattttaactgtgtgttcctatgggaaatattgaaattctttgtattttatacaaatttatattttaaccagtttgtgtattttttttccatctgctaaaggttttagctgtatttattagatatgatacttatgatgttgtcttggaggaatatttttattttggtgcttactttagtactgaaaaagcatcttaggcaactgaaatctacagtaaaaaatattttaattcatttggaataatcttggataattcgcttacagcttcatttatcttgcaaaaatttagtgacaattctttttaaaatatacttttttcttttgaaaacttaaatagttcgaaaaccaaacattgtgtgttctcactgatatatgggtgctaagttatgaggacgcaaaggcataagaatgatacgatggacattggggacttcggggaaagagaaggaaggtggcgagggataaaaaactacaaatatggtggtgtgtatattgctccagtgatgggtgcaccaaaatctcacaaatcaccactaaagaatttactcatgtaaccaaataccacctgaaccccaataacttatggaaaaatgaaataaaaaattaattaatttaaaaaaactgaaatagttcacataatttaaaaaaacttaaatagctcacataaatgagttacatatattaccataaaatgctacaatctgaagcctcctgtccccagaacatcttctagtacagttctctaattttacaaatatcaagaaaagtaaagtaacttgtttgtaatcacgatatttgttataggcagagttgagacttagaactgaagtcttctggcacctatttctgaactgatcccattattttatgtggcttcaagaaactgaaaattgttctcattagataagctaacataagttaaattatattttattattcatattaatattaatatattaatttatattaacataagttaattctgtttcattgcatgttttccagagtcaaaacatttttggcctcgatgtcattgaaacaccagaaggagacaagatgccacaactgattgttcaaaaggagttagatagggaagagaaggatacctacgtgatgaaagtaaaggttgaagatggtggctttcctcaaagatccagtactgctattttgcaagtgagtgttactgatacaaatgacaaccacccagtctttaaggagacagagattgaagtcagtataccagaaaatgctcctgtaggcacttcagtgacacagctccatgccacagatgctgacataggtgaaaatgccaagatccacttctctttcagcaatctagtctccaacattgccaggagattatttcacctcaatgccaccactggacttatcacaatcaaagaaccactggatagggaagaaacaccaaaccacaagttactggttttggcaagtgatggtggattgatgccagcaagagcaatggtgctggtaaatgttacagatgtcaatgataatgtcccatccattgacataagatacatcgtcaatcctgtcaatgacacagttgttctttcagaaaatattccactcaacaccaaaattgctctcataactgtgacggataaggatgcggaccataatggcagggtgacatgcttcacagatcatgaaatccctttcagattaaggccagtattcagtaatcagttcctcctggagactgcagcatatcttgactatgagtccacaaaagaatatgccattaaattactggctgcagatgctggcaaacctcctttgaatcagtcagcaatgctcttcatcaaagtgaaagatgaaaatgacaatgctccagttttcacccagtctttcgtaactgtttctattcctgagaataactctcctggcatccagttgacgaaagtaagtgcaatggatgcagacagtgggcctaatgctaagatcaattacctgctaggccctgatgctccacctgaattcagcctggattgtcgtacaggcatgctgactgtagtgaagaaactagatagagaaaaagaggataaatatttattcacaattctggcaaaagataacggggtaccacccttaaccagcaatgtcacagtctttgtaagcattattgatcagaatgacaatagcccagttttcactcacaatgaatacaacttctatgtcccagaaaaccttccaaggcatggtacagtaggactaatcactgtaactgatcctgattatggagacaattctgcagttacgctctccattttagatgagaatgatgacttcaccattgattcacaaactggtgtcatccgaccaaatatttcatttgatagagaaaaacaagaatcttacactttctatgtaaaggctgaggatggtggtagagtatcacgttcttcaagtgccaaagtaaccataaatgtggttgatgtcaatgacaacaaaccagttttcattgtccctccttccaactgttcttatgaattggttctaccgtccactaatccaggcacagtggtctttcaggtaattgctgttgacaatgacactggcatgaatgcagaggttcgttacagcattgtaggaggaaacacaagagatctgtttgcaatcgaccaagaaacaggcaacataacattgatggagaaatgtgatgttacagaccttggtttacacagagtgttggtcaaagctaatgacttaggacagcctgattctctcttcagtgttgtaattgtcaatctgttcgtgaatgagtcggtgaccaatgctacactgattaatgaactggtgcgcaaaagcactgaagcaccagtgaccccaaatactgagatagctgatgtatcctcaccaactagtgactatgtcaagatcctggttgcagctgttgctggcaccataactgtcgttgtagttattttcatcactgctgtagtaagatgtcgccaggcaccacaccttaaggctgctcagaaaaacaagcagaattctgaatgggctaccccaaacccagaaaacaggcagatgataatgatgaagaaaaagaaaaagaagaagaagcattcccctaagaacttgctgcttaattttgtcactattgaagaaactaaggcagatgatgttgacagtgatggaaacagagtcacactagaccttcctattgatctagaagagcaaacaatgggaaagtacaattgggtaactacacctactactttcaagcccgacagccctgatttggcccgacactacaaatctgcctctccacagcctgccttccaaattcagcctgaaactcccctgaattcgaagcaccacatcatccaagaactgcctctcgataacacctttgtggcctgtgactctatctccaagtgttcctcaagcagttcagatccctacagcgtttctgactgtggctatccagtgacgaccttcgaggtacctgtgtccgtacacaccagaccggtaggtatccaagtttctaacacaactttctaactatttttttattattattttcagttgatgtagaactttacaaaatctattgacttcaaagagggatcaaaacaatcatattctacagatgtacccaatagatatatggattcaattaagtttggtagaagatgagaacaaaataactactgatttaggaaaattggatgcagaataataattatagtaggggcaattttgtctgtagatggcagtatgacaattcttgctagagaatatattgaaaaaaacttcaacacaaagggttgtagcactgtcctcagtaccattgtgtgcatgaggatcagaatagtctgggctagatacatcacattaaagcttttcagaatctgataaatagctctaaatactaatgatattgagaagcctagcttcacttgggaaaatctgtggctgttcacagaaattcagcaccaagttattccccccatactctaccaggccttcaggtcctcataaagaaaagtgtcgttttcagattaggaactcaaaattattttggtgcatcaaatctacagtcacacaatataacaagaatgggattagaaaaatgaaagcctactcattctcatctttaagccagagaatgaaatatatatgaggtctctggatagctatttaaatatttgcatatttatgcaaggtattttgagcccttcagaagacattcttaaaagataataacttttggaaaataaaatgtttgctttctctaataggcacaaagaaaactgtgggcatgttaagacccaagaaatctgtgcacaataacttaaaacccaatacatttatgaaagcaagagtttatccagtgccttttatcagtgttccatgaagaaatgaatacaaatttatccagaaactcttaaatgttgaatgatttaaatataattgttccctttaaaaagacaagcaatggaatttacccacatttttttctcgaagtcatgctacatgttgagtttattattttgtctgtgttaactcttaaaaaagtattaatcttagtttcagggaataaagtcttttgaacacctattcaggcttaacaaaatagtagcaatgtgaaaatcaaaactgattttctttcaccaaaagttcgagatattaaagaaggctactgcattcaagatagcaatgcaaatagtttaccataactttggaaatgggtttaagaatggaggtcattcaagcataagcgcagttatataatacgataacattaacttttctctctgaatcacacaatgaacgtaaggtactaattcagatgtgggtgcatttttgttacagtaggtacacaattaaatgctgtttcaaaaggtaaactagaaccctagtgtctgtatagagagcttctgttagactttaaaagaatttacgctgcagttgttatttctacagtttagatgaatcccatattttacatagttagtggatctgggatgggcaacaaacgttaagagatgtcgaacatctccacagggtgtgtttttgtttatatttaaccattaaaaagggcactctcattttcaaattcttattgctattctgcttattggataagtttctcaacataaaagtatcttttatgactaacactacatgatttgggtataataacattttttcctgggtttaatttgtgactttctttaagaagtgtacaaagagtgggtttgtgaattacatatgtagatcatcatttttaatagatttaatgaagttaattaataaagcaagttctggtttcagtgctttttgaaggcacagagatattttatgagctagactgattttacttgagtttatgaacacatagcaaggagggcatggatgaagaacaaaaaactgaagtatttttcaaatatcctcacttttttgtttttttaaaaatattttgtaatcctaaaaagtcattaaaaataataaacctttttccatgacgcattttatatcatataactaagagacattttctgaatcataagaattagtcaaaatacaaaaaagtaaatgctaatgagaatcagttattggttgttatcaggtttttattaactgaaaggactatcttagaatcattgaattagcagatgacttatttatttcacagcttaaaaagtaaataaattatatattttattattggttcacagttgtttcatattcattactaaatatcttcaagacatgaattggtgaacttaggcagactaatatgatactaaaaataatttgaatctttacattttgtgctacatttgcaatgttctttaccttttctatatgctcttcaatttgtgtttaatgttagggtgttcaatgatgttgcagaatgctagcaaaataagtgagcactgaaaaagaaattatgtatttaaaaattcaaatgcagtaggtgtcttctttttaaagaaatatcatacaaaatgggagaagtgacagccaatacaatacaaattcattgttccttaaggaaatacttagagtggaataaaatattactgttagcagaaggcagaattattccaatttattttaaacagtgagaaatgcattttcaaaatgagggtttggggaatatttacatttagttcattactcgtctgaatagaaacaggaaagtggaaaataaaatgttctagtagactataagagacaagggaattcatctgaaattttatgttttataaagggaatcaaatactttctagttctcataatttctcattctccttgatcattctataggttgtttttctgacttggatgttctgaaaatatatggaacatttattagataggagtacatatattgcataaagccatctatacctggggaatataatggtcgtctttggcatacgtttctacatgtattatggaaggcatttttgtatacattgtagtagaaattttaaaaacatgaaatttgagaggatgaggctacacattatcttctattaacacctttcaaaacaagcagatagcaattggttgttatgacactagagaaaccataagtataaataattattttaaaatcacttttgatcaatgtcatataaaagagataaactgccaaaaccaagtcttgcttaatacaattcacccattaaatattgtgaagactatacattttaaaaaaatagagaggagaataaaaatgaaagtagaattttttgaaggtcttccagtcactgtctaagacaagtatttggggtacatcattttccaaaaaacaaacaaacaaacaaaaaaccttacaagtttctgtgatttgagttggaatagtctttcagtttcagaaatgaggtgaatgaatggtgaaaactttagacagttctaattcatgcatgaaaccatcctgtagatatgatacatggatttgaaatgataattgcagtctgagttagcttggaataggattggtattcactattgtaaaattcagtaactttgactctgcatttatattttggtaatgcaaattttaaccatgaagcatgcttggcaaatgaaactcctagaacacaaccatctgattttgataacgtgttatttttcttgtcctagactgattccaggacatcaactattgaaatctgcagtgagatataactttctaggaacaacaaaattccattccccttccaaaaaatttcaatgattgtgatttcaaaattaggctaagatcattaattttgtaatctagatttcccattataaaagcaagcaaaaatcatcttaaaaatgatgtcctagtgaaccttgtgctttctttagctgtaatctggcaatggaaatttaaaatttatggaagagacagtgcagcacaataacagagtactctcatgctgtttctctgtttgctctgaatcaacagccatgatgtaatataaggctgtcttggtgtatacacttatggttaatatatcagtcatgaaacatgcaattacttgccctgtctgattgttgaataattaaaacattatctccaggagtttggaagtgagctgaactagccaaactactctctgaaaggtatccagggcaagagacatttttaagaccccaaacaaacaaaaaacaaaaccaaaacactctggttcagtgttttgaaaatattcactaacataatattgctgagaaaatcatttttattacccaccactctgcttaaaagttgagtgggccgggcgcggtggctcacgcctgtaatcccagcactttgggaggccgaggcgggtggatcacgaggtcaggagattgagaccatcctggctaacacggtgaaaccccatctccactaaaaatacaaaaaattagcctggcgtggtggcgggcgcctgtagtcccagctactcgggaggctgaggcaggagaatagcgtgaacccgggaggcggagcttgcagtgagccgagatggcgccactgcactccagcctgggtgacagagcaagactctgtctcaaaaagaaaaaaatgttcaatgatagaaaataattttactaggtttttatgttgattgtactcatgctgttccactccttttaattattaaaaagttatttttggctgggtgtggtggctcacacctgtaatcccagcactttgggaggccgaggtgggtggatcacctgaggtcaggagttcaagaccagtctggccaacat

SEQ ID NO: 26 - DNA, 4042 bp, Homo sapiens
tgtgctttagttgcagtggaaaggaaatgtgtcatctgtggtttggttttaaaagtggaaaactagctgcacatatccttttttactgcagatttactttaaggctcatattctccaagtctattctgctttaaaaagaagacaagaaaagaagtggtttatcaaaatcacgttataatcagattttgaccaagcattttgtaaggtaggtcatatatatacggcttttcttatgccttttcacttctaacgtctgacagattagtgttcgaggaaatgctatcaaagtgtgtaagaatctcactaacaaactagaattgtgactgaaaatgtatactttttttttctgtcctgttacataaattttaagttagaaatgaaaaaatttgccatcgccatggagttttaaattaggattacgaaggatctaagtttggtttcctcaagtaaactggaaatgttttgttatttttcaaaagttaaaaaataaatttctcattactaatgcttggacattacaaattctactgaaaataaattctactgaaaatgatcagatataagaaaacttctgataacacaacctggcctccaaggcataaactggagtaaaaacagtcctcaattctcaggcatttgtaagggcaagagaaagtctcattttgtcatacagtttgtttatttgggcactgcagtacatctggctgaagacaatcaacagcaggcctattatctgttccgtggtaagcactgttaaaatgtgtaccaatactatgatgtatactacactgttaatgaactaatgtgaaaagaataatctactttaaatcattctagcatctaatacagaagtccagtctagtataaaaagatggaaattacttgctaatccaatttcaagtatttctttttgtggaagaatcatgaaatatccaaagatttatgtcactaaacttaaaaattaaagctgaacactattatacaaaagccagtgacttgggcctttaattgtctactaaaggtcataatctaaaaagtaatcttaatcctggaatatttaatagtttttcctccctactattaatatgaaatatagtctccagttagcattgtttattacatgctacttttgtttgcataactcaacgtatcacatttcttattttcaatttctgtattttaatagtatacaaatgtcagccaatgacatataacaaccatttcttataaaaccttgatgttcaaaagcctgactagcagtggcatccatgttgcttaggagttggtttggaaacaaagactttcaggccctacctatactagctaggtaagaatctgccttttttttttttttttaaataaaaggactcctaagtacatttgagaagaatttctatagcatacgtagggttcttaaccaggcaatttcatttagtaaatctcaggagaacaatatagttttgcttttagttcattcaaataaatgctaacaataaaatactcctttcaaaagtagctcaagacaaactggtatattattataagataccttaataatgattataaatctttcctgctgggttagcagtacatggaactgttaaattctaagatatgccatttctatttaaatcaatcatttggtagatttaaaaaatgtataatataacttgtctcctttttgtactagtttccagcaagctcagggccaaagcggaaattcaacattttcaattatctgttgagatgcttataacctgccacttcatcccaaatcatcaagatcctgatgctctatttctattttattacacatttttttttacaattatgtcaaaatcagaaaaaatgctaggtataaatgatgctttaaaagaaaacccagcaacttttgttgaacttttaagtctactcagaggaaatttgctgtttttttttttttttcttcagatttttaggttgagaaaactggtatgcctttgccttcagaaagacacagtcagtccagggaaatataaatgaaaagagacaaccaccacagtaaaattgcgttcacaaatacacttacaaatgtatttctaagtaccagctttattctaagcttcaagatgaacacccaagaaaaaaaaagaacaccttgaatttctatttgaagttcagtttcttttggttgctaccaaacttcccctctttccaccaaaaaaatttgcatttatttcatacatgaagcaagaagctcaaggccacatttcttctgtaaagattggtgacaggttagagggtgggtagtttctgtaagaatgatccttaatttttttttttttttaaagaaggaatcagaaaagtaaaagcagaactaactgactcaaagcagaagtctagcacgcttcaaaggaagaaaactatataaagccatgatagtccacttaaaatgattaatatttatttgtaatgctaacttctagcatctaaaagtgttaatagaaattaaaatgcttcttcatacatagctgaatagaaaagaaatttagttgagaaggaattcagggtagcgaatattaggcataagcttgtagtttacttgtaacatctcaacactatcttttaactacaattaccaaaactaggatccattattctttcacaaactaacaaattatattgctatcccaacagattgccaagcatgcccacggacatggaacacacaggacattacctacatcttgcctttctgatgacaacagttttttctttgtctcctggaacaaaagcaaactatacccgtctgtgggctaacagtacttcttcctgggattcagttattcaaaacaagacaggcagaaaccaaaatgaaaacattaacacaaaccctataactcctgaagtagattataaaggtaattctacaaacatgcctgaaacatctcacatcgtagctttaacttctaaatctgaacaggagctttatataccttctgtcgtcagcaacagtccttcaacagtacagagcattgaaaacacaagcaaaagtcatggtgaaattttcaaaaaggatgtctgtgcggaaaacaacaacaacatggctatgctaatttgcttaattataattgcagtgctttttcttatctgtacctttctatttctatcaactgtggttttggcaaacaaagtctcttctctcagacgatcaaaacaagtaggcaagcgtcagcctagaagcaatggcgattttctggcaagcggtctatggcccgctgaatcagacacttggaaaagaacaaaacagctcacaggacccaacctagtgatgcaatctactggagtgctcacagctacaagggaaagaaaagatgaagaaggaactgaaaaacttactaacaaacagataggttagtgaagaaaaatgcaaagtagcaatgagaaggcttatggagtaaaaatgaagtcagttggtatttaatcccaaagtgttgttctgattatctaaaatttgacatggtagaccttgcaatttagaatcaagcaggtgagacagggagaagtatgcctgcttaattatttaaactgtgtacttttgttttgacactgaatattttaaaaagcaaataataaaataactaagcatttgaggaaaattttaaggataaattgaggaaactgattaatagagatagcaagggataattaaataaatattccctatgtagcaacagtggttagatgatctttgtctgaatgtaattaaactttgaatagttttagtgtgtccttaaagccaagtatatgctttaacatcaaatggaagtcaaattcctaatgcatagatagagagagctaaactgtgtaatttaatggtatcttccttgctggatgtggcagaatccacaccagcttatcaaccaacacagctaattttagaatagatcctttatctttccatatggcacacgtaagaaagtgtttttctactattaatattaaattaaaacctttacttttgtataataaattaaaactcagaataaacctgtgaccacgt

SEQ ID NO: 27 - DNA, 24307 bp, Homo sapiens
tacctctcgccgcccctagggaggacaccatgggcccactgatggttcttttttgcctgctgttcctgtacccaggtaggaggcagggaagggggaacgtcagggtcctgtgtgtgaggttggtgctcccagcttgaattcccatgtgtgaaacagtctcttttgctttccttttctcatctgtgtcttccttctttctccattgctgtctccttgttcccacggctctaggtctggcagactcggctccctcctgccctcagaacgtgaatatctcgggtggcaccttcaccctcagccatggctgggctcctgggagccttctcacctactcctgcccccagggcctgtacccatccccagcatcacggctgtgcaagagcagcggacagtggcagaccccaggagccacccggtctctgtctaaggcggtctgcaaacgtgaggctccctgtgggctttgctcagggtgctacaccaggggccaccccagaacttttgtttaggagttgctcagggtgggacttaacctgactagatggcaaagttgcttttgcagagggcttttcaaaatatccagaaaatgtcaattgccagtagcaaggaattgggaacaggtcttgatggagactgtggggtactaaagccagggatgactttttatgtacaattgactgcctagtagtgaccattcagaacagatgctgaatggtcctggagtcctctagacatctgaggatcccaaggggagtgtctggggaggccacggccctcaggagactgagggaagtggctatttatcaatcagttcgcttagactctgtgaaattggcaatattcaatcagttgccaaaaacagcaatttcacatgttgcaacctaatatttcagtgttttgacagccagttgaccattcccatgcattccagcataaaatcacctgcttaatccccagcccaggtgttatccatccagtcctatattccccacccacttcctctctctccagctgtgcgctgtccagcccctgtctcctttgagaatggcatttataccccacggctggggtcctatcccgtgggtggcaatgtgagcttcgagtgtgaggatggcttcatattgcggggctcgcctgtgcgtcagtgtcgccccaacggcatgtgggatggagaaacagctgtgtgtgataatgggggtgagttctctggctgatgggctacacagggggctggggtctcctggggaaccctggggcccaatgtgcatccaggaagcctctgtggggataggagtctgttgttcagtgtgccataataatattcctggattttggtaaattgaggtctacaggtcacacatcacaagtctgcaagggccaggccccaggcagctggtgctaagcttcagatgtagcataaagcctccacacactctgcctggcttttctaagtgcctcaaagcaagacttcatattcaggccccacagattgttgtagggaagatatgctgggagagagtcaagtactgtgctttaatgccttgcctttaaagccaggtttgggttccaagccctactctgactttgacagactttgggaaggctatttaacctttctagccctcagttttcccatctgtaagacaaggatagtgagtgctgacctgagattgccatctggattaaatgagttgacattagtaagcatatacaacagccctggagtgcggtggctcacgcctgtaatcccagcactttgggaggccaaggggggtggatcacaaggtcaggagtttgagaccagcttggccaacatggtgaaaccccgtctctagtaaaaatacaaaaattagccgggtgcggtggcgcatgcctgtaataccagctattcaggaggctgaggcaggagaatcatttgaaccaggaagtggagattgcagtgagccgagattgcatcattgcactccagcctgagtgacagagtaagactctgtctcaaaaaaaaaaaaaaaaaaaaaaaatgccagcctcggtgcctcacgcctgtaatcccagcactttgggaggctgaggtgggtggatcacctgaggtcaggagattgagaccagcctggtcaacgtggtgaaacctcgtctatactaaaaatacaaaaattagctgggcgtggttaatcccagctactcaggaggctgaggcaggagaatcacttgaacctgggaggcagaggttgcagtgagccgagatcgtgccactgcactccagcctgggtgacagagtgagactctgtctcaaaacaaacaaacaaacaaacaaacaaaaaacaaaaaaaacagcccctggaatctgataaatgccatgtacacttttttttttttttgagacggagtctagctcttgttgcccaggctggagtgcaatggcgcaatctcagctcaccgcaacatctgcctcccgggttcaagtgactctcctgcctcagcctcccaagaagctgggattacaggcatgcgccaccatgcctcggtaattttctattcttagtagggacagggtttctccatgttggccaggctggtctcaaactcctgacctcaggggattctgcccaccttggcctcccaaagtgctgggattacaggcgtgagccacggcatccggccttgtttttgtttctttaagagacaggatctcgctgtgttgccaaggctggcttcaaactcctgagctcaagtgatcttcctacctcagcctcctcagtagctgggaatgcaggcatgtgccaccacacctggccataagcacttttgtcatagttattgctgcccctgtgaatggtgaggggctctgcttggcagaagtagggctcctaggattccctggagctgcatttgcctgtgggtttgggagcttcttggatcatggttcttagcacatcatacagaagacacggagtccacaagatggcaggaccaccttcacctagtggcccagaccatggatccccactcatgcccttgggttttggcaaatggccatttattctgtaggagggtgaagtagatgcctggtaagactgtgataagtaatgcttgaattattagacgtgactctaacttattttaaaattgaggcataatttacctattgtaaaatgtacaaatcttaactattcagctcaatgatttgttacaatgcatccactcatctaatcaccacccaagacagaatgaggttccctcttgtcccctcccacaaggtaactgctcttctgacctctgtctccatggactaggtaccttgtgcttacatttcctgtaaatggaatcatgcgggatgtggtctgttgcttctggcatcctttgttctatattctgcctgtgagatttatccatgctgttgtgtgtatcagtactttgttcttttttattgctgtgtagtattccattatatgggtatattacaatttatccattcccctcctgatggacatttggattatttccagtttggggccattaggagtaaagctctaggaacattctttttttttttttttttttaattgatcattcttgggtgtttctcacagagggggatttggcagggtcacaggacaatagtggagggaaggtcagcagataaacaagtgaacaaaggtctctggttttcctaggcagaggaccctgcggccttccgcagtgtttgtgtccctgggtacttgagattagggagtggtgatgactcttaaggagcatgctgccttcaagcatctgtttaacaaagcacatcttgcaccgctcttaatccattcaaccctgagtggatacagcacatgtttcagagagcacagggttgggggtaaggtcaccgatcaacaggatcccaaggcagaagaatttttcttagtacagaacaaaatgaaaagtctcccaggtctacctctttctacacagacacggcaaccatccgatttctcaatcttttccccacctttcccccctttctattccacaaaaccgtcattgtcatcatggccccttctcaatgagctgttgggtacacctcccagacggggtggtggccgggcagaggggctcctcactttccagtaggcgcggccgggcagaggcgcccctcacctcccggacagggcggctggccgggcggggggctgacccccccacctccctcccggacggcgcggctggccgggcggggggctgatccccccacctccctcccggacggggcggctggccgggcggggggctgacccccccacctccctcccggacagagtggctggccgggcagaggggctcctcacttcccagcaggggcggccgggcagaggcgcccctcacttcccggatggggcggctggccgggcgaggggctgacccccccacctccctcccggacggggcggctggccgggcagagtggctcctcacttcccagtaggggcggccgggcagaggcgcccctcacttcccggacggggcggctggccgggctgggggctgacccccccacctccctcccggacggggcggctggccgggcggggggctgacccccccacctccctcccggaccaggtggctgctgggcggaggggctcctcacttctcagacagggcggctgccgggcggaggggctcctcacttctcagatggagcggttgccaggcagagggtctcctcacttctcagacggggcggccgggcagagacgctcctcacatcccggatggggcggccgggcagaggtgctccccacatctcagacgatgggcggcagggcagagacgctcctcacttcccagatgtgatggcggccgggaagaggcgctcctcacttcctagatgggatggcggccgggcagagacgctcctcactttccagactgggcagccaggcagaggggctcctcacatcccagacgatgggtggccaggcggagacgctcctcacttcccagacggggtggcggccgggcagaggctgcaatctcggcactttgggaggccaaggcaggctgctgggaggtggaggttgtagcgagccaagatcacgccactgcactccagcctgggcatcattgagcactgagtgaacgagactccgtctgcaatcccagcacctcgggaggccgaggctggtggatcactcgcggttaggagctggagaccagcccggccaacacagcgaaaccccgtctccactaacaaaatacgaaaaccagtcaggcgtggcggcgcgcgcctgcaatcgcaggcactcggcaagctgaggcaggagaatcaggcagggaggttgcagtgagccgagatggcagcagtaccgtccagcttcggctcggcatcagagggagaccgtggaaagagagggagagggagaccatggggagagggtgagggagagggagctctaggaacattcttgcatgtgattttggtacatgtatgcacttgcttctcttgagtaaatgatctaaatgtggaattgtcacatcacaggctggcatatgtttagttgtagtagaggctgagaaagtttcacccacgtacatgccagcaaggtaacagagtgccagtcgctctgcatcctctccaacacttggaattacctgttgtttcagtgttagccgttttgatgggtgtgtagggatgcctcactgtggtttatgaaatataaatgttctctgaaggagtggagggaccatcagctgacttcttccctgggtctctgggggctctgggacagacatgggtgcatccctgggttggaactgggaagcttctgctggcaactgaggccgctgaggaggcagagcctgatgggagggggctactcacctctgccttcctttgttcactcgcagctggccactgccccaacccaggcatttcactgggcgcagtgcggacaggcttccgctttggtcatggggacaaggtccgctatcgctgctcctcgaatcttgtgctcacggggtcttcggagcgggagtgccagggcaacggggtctggagtggaacggagcccatctgccgccgtgagtagctgccctgccctcctgagattcctcggcacacccggccactgccccggctgactcctgtgtggctctccccacagaaccctactcttatgacttccctgaggacgtggcccctgccctgggcacttccttctcccacatgcttggggccaccaatcccacccagaagacaaagggtgagtgtttgaggtggggtttctggttgagcagggtgctggatctgggccggagcaagggaggatgcaaccttcctggaggccaggagccttggtgggctcagccactgaaagggagggaggcagagaagctggacctgcttggcgagagcgcaggaaggaggtggggatctgaatcctccccttccacatttctccagaaagcctgggccgtaaaatccaaatccagcgctctggtcatctgaacctctacctgctcctggactgttcgcagagtgtgtcggaaaatgactttctcatcttcaaggagagcgcctccctcatggtggacagggtcaggaatcaggagtctgcctgcagcagaggccttcctgtgctcactatctctctctgtctccttcccctcctcagaaccccactcacagcccacctcctccaagaagtcttctcagattatactcatgccatgtaggaatcatgaattcaatttatacaatcataatttttattccacaagcactgttgggacactgtgctggggctgggcgacagcaaagatggaaaggctgaggtcttactttccaggaattcatcatctagaacagtggtctccacagaaaggtagtgagataacccacaggagtgaagcagaaaaatactggtgcccctgtggaataatttaaatcagattaataatttaatatttaataatttccttttaaaacttcaacattttgtgcaggctttaaaatgtgtgtgatagactgggcatggtggctagtgcctgtaatcccaacactttgggaggccgaggcaggtggatcacttgaggtcaggagtttgagaccagcctgaccaacatgatgaaaccctgtctatactaaaaatacaaaattagccacatgtgatggcgcacgcctgtaacccagctacttgggaggatgaggcaggagaatcgcttggatccgggaggtggaggttgcagtgggctgagatcacgccattgcactccagcctgggcaactagagcaaaactctgtctcaaaaaaataaataaaataaaataaaataaaataaaatatgtgtgatagaagtttggaagccactggtttaagttcctcgccagaactttgttttgtaattgtgcttttcacaatacttcatgtaacattatagatggttttccctcccagctacattttaaagagggcagtttctgtgctctcttgggactcaaaattaagtaactcattgcactgcgaggcggcaacacacaccagttggagcagtgattgagaatcatgtgacacattcagatcccacttccacctcctcctcatggtgtgatgggggaagggggacaaggcaacatacctcagtttccttatccataaaataggggtcatcatgcccctcacagggtggagtgaagagagtctgtcaaagagaaagatgttcaacaaaggtttcttccttagctgctgctgttccttatttttattattattattattattattatttttgagatagagtctctgtcacccaggctggagtacagtggtgcgatctcagctcactgcaaactttgcctcctgggttcaagtgattcttctgcctcagcctcctgagtagctgggattataggtgcttgccaccataccaggctaatttttgtatttttagtagagatgggttttgccatgttggtcaggctggtctcgaactcctgacctcaggtgatccacctgcctaaagtgttgggattcaggcatgagccaccgcgcccagcccctagcttcttcctaacagccatttcctagtgtctcccctggtccttgcctctgtcggtctcactccagtttctctgcctcctccagggccctttgtttgctctcttaccatctcccctttggcttcagggccctttacgctgcctctcacttgccccgcacagatcttcagctttgagatcaatgtgagcgttgccattatcacctttgcctcagagcccaaagtcctcatgtctgtcctgaacgacaactcccgggatatgactgaggtgatcagcagcctggaaaatgccaactataaaggtacgggtgtcatcacgtgatggtgatgagagaggagaagatggaccctctcagggcctgcaaacaaattctggatgagttaaaaagagagtgaggcctcttggtggcacctgagtcccacgagtctggggtagtttcaacgtccagggttatggtgggggagtccagctgcccccagctcatagctcattctgagatgctgcaggtccaaagacactgtgcaggtcttcaattccttccagttgccaaaaccacactgtctggtttgcatggctgcacactgccatctccccatgtcattagccacccatacaccatgtaaagtgcctggttggcacttagcaaatggctgaagccactcaaggttttggaaacctcatctttgaatcttgggactttagtgtggtcttggattggggttatgcaatgaacatttcttttttcttcttcttttttttttttttgaggtggagtctcgcactgtcacccaggcttgagtgcagtggcacgatcttggctcactgcaacctctgcctccagggttcaggcaattctcctgcctcagcttcccgagtagctgagatttcgggcacctgccaccatgcctggctaattttttatatttttagttgagatggggtttcactatgttggtcaggctggtctcgtgatcctgactttgtgatccgcccacctcagcctcccaaagtgctgggattacaggcgtgaaccaccttgcccggccctatgcaatgaacatttctaaggtggaaaggcttttaaagtttgaacaagcaatgatgccacatctctatctgaatggcaaatgtctgagtttatcaaaacaatcgataaattgcatttccaggccgggtgcagtggctcatgcctgtagtaatcccagcactttgggaggctgagatgggcggatcacttgaggtcaggaaaccagcttggccaacatggtgaaaccccatctctactaaaaatacaaaaaattagctgggcatggtggctggcacctgtaatcccagctacttgggagactgaggcatgagaatcacttgaactggggaggtggaggttgcagtcagccaagatcacgccactatactctagcctgggtggcagagcgagactctctcaaaaaaaaaaaaaaaattgcatttccaataattgggggaatagagtgattccctacccctaggtggtaggtgggaagtttctaagagagtccttccttttggcatattccagatcatgaaaatggaactgggactaacacctatgcggccttaaacagtgtctatctcatgatgaacaaccaaatgcgactcctcggcatggaaacgatggcctggcaggaaatccgacatgccatcatccttctgacagatggtgggtatcatggtctctgagtgtgtctggaatagtggaaggggcaccaatatggggtcagaagccctgaattctgattctccctctgcctgccactttgggccccagttttgtttttgtttttagagatggggccttgctatgttgcccagctgatctcaaactcctggcttcaagcaatcctcctgcctcagcctcccaaagtgctgggattacaggcatgagccaccacacctggcccagtttcttatttataaaatagggccagtgtggtggcttatgcctgtagtcccagcactttgggaggccaaagcgggtggatcacttgaggttaggagtttgagatcagactggctaacatggtgaaaccccgtctctactaaaaatacaaaaccattagctgggtgtggtggcaggcgcctgtaatcccagctacttgggaggctgaggcaggagaattgcttgaacctgggaggcagaggttgcagtgagccaagatcatgccactgcactccagcctgggtgacagaccaagatcctaccttgtctcaaaataaaataaataaataaatagaattagtgttgatgatgatgaccgtaaccacaatgacagcaatgatgatcatgatggctgtcctcctttccttacacaatttttatggaaagctatttaagttgcctgtgtgaaagtgctctgtgttagctcttgttaccatctgggaggtaacttggagatagatgaggaaacgtggctcttgagcaggaatgtcgaagggcacggatgcaaggaacagtctgtagtggatctggccttgtcatttgcctcttgctattgtccaaattacacagttcctccaggacttagtatataaaatgaggatacccactctacctggggtttcatgagaattaaatgagttaaagtataggaagcacctggcctggtgcctggaatgtagaacatttcagtaaaagtgtgtatatatatatatgtatgtatatatatatatatgtatacatacatatatatatatatatatttatttttttgagacagggtctcactctattgcccaggctggactacagtggtgcgatctcggctcactgcaacctctgcctcccaggctgaagcaattctcgtgcctcagcctccagagtagctgggactacaggcatgtgtcaccatgcctggctaatttttatttttattttttgagatggagtttcactcttgttgcccaggctggagtgcaatggcgcgatttcggctcaccgcaacctccgcctcccaggttcaagcgattctcctgcctcctgagtagctgggattacaggcatgtgccaccacacccggctaattttgtatatttagtagaggtgcggtttctccatgttggtcaagctggtctcaaactcccaacctcaggtgatccacctgccttggcctcccaaagtgctgggattacaggcatgagccaccatgcccggccacacctggctaattttttgtggttttagtagagacagggtttcaccatgttgcccaggctggtctggaactcctgagctcaggcaatccgccttcttcggtctcccaaagtgctaggattacaggtgtgagccaccatgcccagcctaaaagtatattttgaagctctcacaggcaatgtaaatgttgaggttcccaggctaaatgctttcctactcttccagggcctggggaaatcctgatattacctagaagaattctttattctctttgttctaggaaagtccaatatgggtggctctcccaagacagctgttgaccatatcagagagatcctgaacatcaaccagaagaggaatgactatctgggtgagcccctgccactgccaccacatttgttctgctcctgcagaggtcatgagatcttcagccagggatcccagcatcttagctatggtccagagccacatggttttatttctgcgttgttctgtacaaaggcaactcatgttgaagagcctggggtcaaactactgcccatggtctcaaccttaccttctttttttttttttttttttttaagacagtgtctcactgacactcagagtatattcctggaaagatgtccacccatgccggcccagaagctggtccagaaagtaacgatgtccaccatgccaccatgaagtgcagtggtgcaatcatagcttactgcagcctcaaattcctggtttcaagtgatcccctcaactcagcttcccaaagtggtaggattacaggtatgagccactatgctcagcccgtcttcacaaattttttaaaattaatttttaaattttttttgagacagaatcttgccgtgttgcccaggctggagtgcagtgactcgatctcaactcactgcaacctccacgtcctggcttcaaatgattctcctgcctcagcctccagagtagctgggattacaggtgtgtgccaccatgcccggctcatttttgcatttttaatagagacagagtttcaccatgttggcagtctggtgtcaaacccctggcctcaagtgatccgcctgccttggtctcccaaggtgctgggattacagataggcgtgagccactgtgcctggccaatttttaattttttaattattatttttaatcaacagctttagacagagaaccttggtttcatcttcagtgggctgtggccatgggcagtttcttcatctgcaaaaggggagtagtactaggacccagctcacaagctgacaggggaagatgctcagacaaacactgcctgcctggcatagaaaaatgcccagcatatgttagccatgaccacgaccgtcgtcgttatcatcatcatcatcatcatagcatctcatgtttcaggaaactttccaggaagaagggacctcgattccctctggggaatgtccctggtggttgctctttcagcagcacagctggctaactaaggctttggcagttgcagcctctaaaggaaaaattcctcaggttcagactaaacacaaattgcactgacctttgatcagaaagtaatttcagagagagagatgctcagacagggagggcagctggttttgagccccaacctttcatcttccccttagctcctctcctttccattcacactgccccctcccccatcacctggccctcgggggtaagctgattcctctttaaaactctggcccaaggaagacaaaatttaaagcccactcccttcctccttagcatcactggaccaaggtcaaatgctacaaaaacattttattgaaaataagcaggaaaccaaacgaaaatagtcaaagaaaacgcacaaggcacgatcgttgtctagctccaactgtaactgtttctatctgggccattgccagattgcctcctggctgaagatctcttggtccacctaagcaccttgctttttacacacaacgcggggctctctgagaacaaaaatgggccacaaggggtgcaaaggctgggagaggagtagactctgtggtctgtctgagggcagttctgactggcaccacagtcggaggacaggcgcggcctgttgtgtgggtccagggcctccagtgggaaaacgtggctttaggcccttctcccagatgctaccttttacagaggaagaccagatctgaggtttagtttccatgttgtgttctgagttctttctattcattcagtcatttaaaagtacttaccaaactaccacaaacctgggtggcttagaacacagaatttctttttcttacagttctggaggttagaagtctgaaatcaaggtgttggcagggccgtgcttcctcagaaggctcttgggaagaattctttcctgccttttccggctgccggcagctccaaccttggcttgcggcagcataaacccattctctgcctctgtcttcaactcgccttcttttctgtgtgtgcctctgtgtcattacatgctgttctcttatatagataggagacccactacctgtgtctttgtgtccaaattcctttcttctttttctgttcatttgtttgagacagagtctcgctctgtcacccagaagcccaggctgcagtgcagtggcgggatcccggctcactgtaacctctgcctcctgggttcaggtgattctcgtgcctcagtctcccaagaagctgggattacaggcatgtgccaccatgcccggcaaatttttgtatttttagtagagacatggtctcgccatgttggctaggctggtcttaaactcctggcctcaaggcgatctgcctgccttcgcctcaaaaaaactgccgggattacaggcatgagtcaccaccatgcccagccagttcacttttttttttttttttttttttgagatggagtcttgctctgttgcccaggctggagtgcagtggtgcaatctcggctcactgcaacatccgcctcccggttcaagcgattctcctgcctcagcctcctgagtagctgggattacaggtgtgtgccagcatgtctggctaatttttgtatttttagtagagacagggtttcaccatgttggtcaggctggtcttgaattcctgacctcgtgatctgcccgcctcagcctcccagagtgctgggattacaggtgtgagccaccgtgcccggctcacctcttctttttttttttttgagacggggttttgctcttgttgcccaggctggagtgcaatggcgcgatcttggctcaccacaaccaccgcctcctggtgattacaggtgtgagccaccacgcctggctctggcttacctcttcttataaggacctcagtcattggattagagctcaccctaatctagtatgacttaatcttaacttgattacatctgcaaagaccctttttccaaataaagtcacagatactggggattaggactcgaacacatctttctgggggacacaattccaccattacagggaataaacaggataagaaaaccatagaacccagcaggtggtaggtgacacaagctaaggggtgttgccatgttgcccaggctggtctcaaacttctggcttcaagggatcctcccaccttgcctcccaaagtggggatgaaagtttgtctggggcattgcagttttagacaggaagaccagggaaggcctcactgagaaggtgacatttgagccaagacttaaaaaggtacgaaagtgagccatgtggaagtctgggggggaggagtgaactaggcagaggcacagctgggcaaagggcctgaggtgtgaccatgcctatggatttgaggaacttcaaagaggctgtgtgctgcaggagagtgaagggcagggagtggcaggaaatgaaggcagacaggtagcagtggggaggacgcaggggtccagctcatgtaggtcttgattggacacagtgagtttcagatgacagcctcctgtctcatggggtagccccaaagccacaggagtctggtgatttccctcttccccaccagacatctatgccatcggggtgggcaagctggatgtggactggagagaactgaatgagctagggtccaagaaggatggtgagaggcatgccttcattctgcaggacacaaaggctctgcaccaggtctttgaacatatgctgggtgagtgagctttgccctccttggtgtggggaggatggtgaggagcccgccagaggcccgtgttgggaacctggacacagtgcccctcacttgcctccttccccatctgatcctcacacccacagatgtctccaagctcacagacaccatctgcggggtggggaacatgtcagcaaacgcctctgaccaggagaggacaccctggcatgtcactattaaggtaccaggaaggaggggcagggcttggattccagaggtaaaagcggccatgggccagacatactgcaatctctgaaaatcacctgttcccctgcagcccaagagccaagagacctgccggggggccctcatctccgaccaatgggtcctgacagcagctcattgcttccgcgatggcaacgaccactccctgtggagggtcaatgtgggtaaggcaggggatgcaccagcctcctgatcctgaagccacagatcctaccacctcacccagcctctggcccctgcaggagccctggtctagcctaatctagtgtatcatttccaggagaccccaaatcccagtggggcaaagaattccttattgagaaggcggtgatctccccagggtttgatgtctttgccaaaaagaaccagggaatcctggagttctatggtgatgacatagctctgctgaagctggcccagaaagtaaagatgtccacccatgccaggtgcctggagtctgggatgggagggtgccctgcagggaagagtgctctggagatccctggaagagatactggggacaggctggtgtgacccttgctcttctccccaggcccatctgccttccctgcacgatggaggccaatctggctctgcggagacctcaaggcagcacctgtagggaccatggtgagtgctgggacttatggtgcttgagagctggggccggggtttgggggtgataacaaggactaggctgcagtccccaagccaggaacctggattctgggtaaaaggaccagcaccaacatccccttctcttgactatagagaatgaactgctgaacaaacagagtgttcctgctcattttgtcgccttgaatgggagcaaactgaacattaaccttaagatgggagtggaggtgagggtctcaggttggggatgctgggatccccctgtgacagctcccagaatgtctctcttccttctccaggtctggctgctttctctctctgacgcgggtcacccctcctcccaagcctcacaaacctgctaggtgtccctgggtctgcttattctttttttgttgttattgagatggagtcttgctctgtctcccaggctggagtgcagtggcacgacctcagctcactgcaacttctgcctcctgggttcaagcgattctcctacttcagcctcccgagtagctgagattacaggtgcccaccaccacaccagctaatttttgtatttttagtagagacgggatttcgccatgttggccaggatggtcttgaactcctgacctcaagtgatctgcctgcctcaacctcccaaagtgctgagattacaggcgtgagccactgcacccacccgggtctgcttattctacccttctctctggttccacccctgctgcagtggacaagctgtgccgaggttgtctcccaagaaaaaaccatgttccccaacttgacagatgtcagggaggtggtgacagaccagttcctatgcagtgggacccaggaggatgagagtccctgcaagggtgagtccctcaccatgcctggattcccaaggggaaggccacctgtgtctctgtggccagcatgcatgccagaacaccagtccactgccctagatgacactgtctcctgtcaccctttgctggcaggagaatctgggggagcagttttccttgagcggagattcaggttttttcaggtgagaaggtagaagcttgcaggacccaggggttacaggatctcagccttgttggggggatgagggaggcctttgagggatctagggaggttggggcttacagttggggctgtggcagcctcccagccagttctctccttttctccaggtgggtctggtgagctggggtctttacaacccctgccttggctctgctgacaaaaactcccgcaaaagggcccctcgtagcaaggtcccgccgccacgagactttcacatcaatctcttccgcatgcagccctggctgaggcagcacctgggggatgtcctgaattttttacccctctagccatggccactgagccctctgctgccctgccagaatctgccgcccctccatcttctacctctgaatggccacccttagaccctgtgatccatcctctctcctagctgagtaaatccgggtctctaggatgccagaggcagcgcacacaagctgggaaatcctcagggctcctaccagcaggactgcctcgctgccccacctcccgctccttggcctgtccccagattccttccctggttgacttgactcatgcttgtttcactttcacatggaatttcccagttatgaaattaataaaaatcaatggtttccacatctctcagtgcctctatctggaggccaggtagggctggccttgggggagggggaggccagaatgactccaagagctacaggaaggcaggtcagagaccccactggacaaacagtggctggactctgcaccataacacacaatcaacaggggagtgagctggatccttatttctggtccctaagtgggtggtttgggcttactggggaggagctaaggccggagaggaggtactgaaggggagagtcctggacctttggcagcaaagggtgggacttctgcagtttctgtttccttgactggcagctcagcggggccctcccgcttggatgttccgggaaagtgatgtgggtaggacaggcggggcgagccgcaggtgccagaacacagattgtataaaaggctgggggctggtggggagcaggggaagggaatgtgaccaggtctaggtctggagtttcagcttggacactgagccaagcagacaagcaaagcaagccaggacacaccatcctgccccaggcccagcttctctcctgccttccaacgccatggggagcaatctcagcccccaactctgcctgatgccctttatcttgggcctcttgtctggaggtaagcgagggtaaccttcccttcctgctgtctccagcatccctccttggccttttggggccaggcttcatcagcctttctcttcaggtgtgaccaccactccatggtctttggcccggccccagggatcctgctctctggagggggtagagatcaaaggcggctccttccgacttctccaagagggccaggcactggagtacgtgtgtccttctggcttctacccgtaccctgtgcagacacgtacctgcagatctacggggtcctggagcaccctgaagactcaagaccaaaagactgtcaggaaggcagagtgcagaggtttgagggcaatgagtgtgggcagtggcctaaggcagaaacagggcaggcggcagcaaggtcaggactaggatgagactaggcagggtgacaaggtgggctgaccgggagtaggagcagttttagggtggcaggcggaaagggggcaagaaaaagcggagttaacccttactaagcatttaccctgggcttccaggcagccctggaagtcaagagaacactcagaaatggggagggagaagcagtggaaatccatatgggttgaggagtaggtaagatgctgcttctgcgggactgggaatgcgctgtttctcagtgacatggtctccgagaccaggagggatacacctaaggcagcctttccctcttgatgacttctacttgtccccccttctcaaagcaatccactgtccaagaccacacgacttcgagaacggggaatactggccccggtctccctactacaatgtgagtgatgagatctctttccactgctatgacggttacactctccggggctctgccaatcgcacctgccaagtgaatggccgatggagtgggcagacagcgatctgtgacaacggaggtgagaagcatcccctccccctacattgctgtctccctgacggcgcccagcccgaggagtgggcactcggctccggacactgtaactcttgctctctaccttgctcacggggcctcaggcttcagtgcttacctcgatgtctcatacctctgcagcggggtactgctccaacccgggcatccccattggcacaaggaaggtgggcagccagtaccgccttgaagacagcgtcacctaccactgcagccgggggcttaccctgcgtggctcccagcggcgaacgtgtcaggaaggtggctcttggagcgggacggagccttcctgccaaggtgacctttgacctgtacccccaggtcagatcctggtcttccatcctactgtcttctctccccacctcaaccctgctctttcctcactttgtttaaacctccctgtacaactatctcacttctgagccttttataccctggaaacccatgatcccccgtctctttggtcactgtatccctgacactcccagacatttgacctcatttctgactctcccagactccttcatgtacgacacccctcaagaggtggccgaagctttcctgtcttccctgacagagaccatagaaggagtcgatgctgaggatgggcacggcccaggtttgaagacagagaagggaggcagggcagggaactgggggaaaatggagaagggacagaactgttaatgctggagcctgagccactctcctggcacccaggggaacaacagaagcggaagatcgtcctggacccttcaggctccatgaacatctacctggtgctagatggatcagacagcattggggccagcaacttcacaggagccaaaaagtgtctagtcaacttaattgagaaggtggaatcctcctatccctgaactcgggggaatggaatctcgctgatcttccaggactagctccctgatcattccagcccctctgaacaacagggccccaggaaaatctccaggtcctattctgtcctccttcccttttacttgaagcagtttcttgactggtaattcctccatgaacctcagcccttgagcctcttactgagagcctccctgtcccagcaaagtcgctgaaatctcccaatcacagtattctattttcaatgccatggcgccttgttctcctcacccacaggtggcaagttatggtgtgaagccaagatatggtctagtgacatatgccacataccccaaaatttgggtcaaagtgtctgaagcagacagcagtaatgcagactgggtcacgaagcagctcaatgaaatcaattatgaaggtcagaggttagggaatggtgggaggttcactttggggtcaggaggttcagggtggagggggtcatgagactaccttgagggcgacagggaggaccactttgtagtcaaaagttgaacagcaggatcgttgggcaatggaggttagtgggaacctgttgggggctggaagggccactttgtggtcaaagggaagtccgtgtaatgatgattaacttaaaaagttgaaagatgtgggatttcagttgcagattggtctctggggttaaaagatggcttggaagaccaggtgaggtgatggtctcttccctctccacagaccacaagttgaagtcagggactaacaccaagaaggccctccaggcagtgtacagcatgatgagctggccagatgacgtccctcctgaaggctggaaccgcacccgccatgtcatcatcctcatgactgatggtcagaagggacctctctcctgtcccagcctccccaccttctcagaccagcatgtggcccttaagtccacttgtaacactatacccatggttggggccctgaatgtgactcatagctggctgttcatctctcctgtgacccttcataaggaattcttcctaagccctgtgatcaactatctctaacccttcctcaacttgctcaccctgccatgtgtatccctgcctttagccagtttatcttccttatctcctaccctcatggtcctgtctcttctgcaggattgcacaacatgggcggggacccaattactgtcattgatgagatccgggacttgctatacattggcaaggatcgcaaaaacccaagggaggattatctgggtgagtaacctgcctaggacccagcaccccacttcctcagggcttggaccctcatccttcctttttatccctcagatgtctatgtgtttggggtcgggcctttggtgaaccaagtgaacatcaatgctttggcttccaagaaagacaatgagcaacatgtgttcaaagtcaaggatatggaaaacctggaagatgttttctaccaaatgatcggtagggagatacaagggaataaagaacacaactctcctcaggttcccctgaagtaattcattcttcctctacacctgaagctctagttgcctggaaagccttcttcattcctccttctctacctcagtgtcactattcttgtttcctggcactgttcacttaaccttagaatcacagagctctgagcacttcagagatctttctatagtcctacatttgacacgtggaaacagaagccaaaggaggtcaagggacagcaagttagcaacaagggtgggcttgaaaacagccaggcctctgacagcttgatcccaagttctttcccttttcagtccaccatagcagttttctcctaacacgaggaaacaaatacccgtggtctttccctttctccttttgggcctttgctccccatagactcctacccaaaaggctgctgccatttgggaatgaagtgttccgagttttcagcacattctccttctctgccagatgaaagccagtctctgagtctctgtggcatggtttgggaacacaggaagggtaccgattaccacaagcaaccatggcaggccaagatctcagtcattgtaagcacagaatcccagtagtggggacttgggggaggtgaggtcaaggtgaaatgggagtaggggaaggaaaaaatggccataagagatggtggtttgtgaaagttgagctttccctctctactgttgtgtccccagcgcccttcaaagggacacgagagctgtatgggggctgtggtgtctgagtactttgtgctgacagcagcacattgtttcactgtggatgacaaggaacactcaatcaaggtcagcgtaggtaaggatgcaactgaaggtcctgggctgcacctatgctctccaggcaacacctcccactttctacagatcctacactccacccatcctcaatgcagccccattccttgcaccccagaccagtcagggatgggggaagacgtgaagttaggaatgacacggggccagaggcaggaagctgcccacaaagaggtggtacctactctcctacttcaggaggggagaagcgggacctggagatagaagtagtcctatttcaccccaactacaacattaatgggaaaaaagaagcaggaattcctgaattttatgactatgacgttgccctgatcaagctcaagaataagctgaaatatggccagactatcaggtgagagcgtccagatccctgaggaaaggctgggaaaggctggaggactggggtgaggagcaggcctggtttgctgttctccttgtcctttataggcccatttgtctcccctgcaccgagggaacaactcgagctttgaggcttcctccaactaccacttgccagcaacaaagtaagacatacttggcaagaggataaggatgagatcccaagagacaagtggggcatgagagggaggtgcaataggaagagatgatgcctggcccagaacctagctctagaagggcttaggggacatctactgagtgacaaaggcaatggggagatgacagtggtgggagcagctgaagtgacgcagtctattcgtccagaggaagagctgctccctgcacaggatatcaaagctctgtttgtgtctgaggaggagaaaaagctgactcggaaggaggtctacatcaagaatggggataaggtgagaaacgggcatcctaaggaggcactctaggccccaatccttcctaagccacttctgttcattacttctccatgcttcccacctcccctacagaaaggcagctgtgagagagatgctcaatatgccccaggctatgacaaagtcaaggacatctcagaggtggtcacccctcggttcctttgtactggaggagtgagtccctatgctgaccccaatacttgcagaggtgagagaatgctctttggttgtgctacaagtgcccaaggcccaacagtccttttctctacagcttctcctctccttgcaggtgattctggcggccccttgatagttcacaagagaagtcgtttcattcaagtgagtcctccctttcctatctggggagatgccaagtggtcagcatgggccccaaagcaggaaagctcaatgcatgtggctagtaattcgaggtaggcagagcctgcctcaccttaggaccgcatgtcttgcctgcgtgtgtcaagaacgaggctgagctgggtccctagtctgattcctttaggtcagctaagacacaagcaggaacagccatgcttccaggattaggaattctactgaatgatccatggcaccccactgcctctgcaggttggtgtaatcagctggggagtagtggatgtctgcaaaaaccagaagcggcaaaagcaggtacctgctcacgcccgagactttcacatcaacctctttcaagtgctgccctggctgaaggagaaactccaagatgaggatttgggttttctataa

SEQ ID NO: 28 - DNA, 16408 bp, Homo sapiens
ggggcagggcgggggcggtggggcctcccctagccttccctccccctctccttcactgtccttccagcaggcacaggaaggtgaggcaaggtgtttccagccggcaggatggaggacgaggaaggccctgagtatggcaaacctgactttgtgcttttggaccaagtgaccatggaggacttcatgaggaacctgcagctcaggtaggcccagggcaggaggcagtggctcccctcctccagggtctcccaccttgcgtcctcgcagagacctgagggaaagaggaaggcacgctgctgtccaagggagggggcagtggcacacacccacccagaccagatggggctgaaatgagtgcctcaaagcacggccccaggggacaggaacagacaaggaggcaactgtccctgtcagggctggcaagtcagcaccggagctgcccaccacctcaacccacccctgcctcccacacagtccaggcatcttctgccccttctttcctgcccgacggggccagggcatgacacttcttggacagatacataccaggcactatctttccaggagggaccaggggcacctccctccagccacttcccagccagttgttgatgctccctcgatgcatctcatccatggggcctggcctgagccctggggacactgagatgaagcagtcaggctccaccctagggtccaaacattcccaccaagttgaggtgacattctcctggggtacatggagtatcacaggacacagttggtagaagtgatattggagcccaatttaccatcaaggagggcaggtggagggcagggagaagcccgggaggtaggggcatggcacagtagggtggccatacaggcagctgggcttcctgccaggactcccagggaggggcagaaggccactcgctgtgtactccggaagctccctggggagagcttggggaccaggatccccactaagcaccgaaggcaagagaccacgagcctggctcaaagaggagggctagccaggacgtgagctaagcactttgtgcacattgttctacctcattcttataaaatgagcttatgaaacattgtcctctctattttgatgaggagaacactgagccctggagacgtgggtgacttgtgccctcatccccagcttgtaggaggatgggagctaggcccaggaaaacccatgtcagaggtggtggagaaagaggaacctcaggacaggcccacccaggacaggctgccgggagacagggccatccagggaagggtgggtaccacacaccaaggggagatgggtctgaggggcaggcctgccagtcctcctcccaggggcagaaaggtcaagagaagggcagacatccacccccactggggaccaggtttgtgaaggaaagggtcaagaagtctgaggctgtgccaggggagaggcagcagccactggccacaggctggggggtcgggggtgtaaagacaacgacatcaactccctccctgtcatctgggtggggctgggtggggtccccttttgtctctgggttcccgcccaggccttgagacaggaaacagccgaggaggcccctccttcccctcccagcccagtcacttctcaaccccatctccccatctgccctgcggggttcaccccaggagccagccctgactcacggcacccagtgcagtcttgggcaagtctgtttcctttgcaaaatgagtggtcatgtttccagtgaccttgggatccctggggagaccactgtggaccccaaactctatgccgcaatggagacagtctctgagtggctcagctcacccaggatggcaccagggagacgcaaggtcaacacctgcccccttcttccttctccactctcagcccgtcagggtgggagcgctggcctactggggccaggccctgatatgggctctggcgaaaggcctgtgggtgcctgtaagcctgtgagtgctgaggcctacccctgctgtgtccaggttcgagaagggccgcatctacacctacatcggtgaggtgctggtgtccgtgaacccctaccaggagctgcccctgtatgggcctgaggccatcgccaggtaccagggccgtgagctctatgagcggccaccccatctctatgctgtggccaacgccgcctacaaggcaatgaagcaccggtccagggacacctgcatcgtcatctcaggtacctgtccctgccgccgggcccccaccctcggcatcttcatttgtgaacatttgggagggccattagagcatctcctgtgccctgtgtcctgatgggggccctaggaccccatcttgccagtcttgggggtgtgagtgggcacagggagctgggctaagagagcgaacctggctgattctctcaactctggtctttccggcaggggagagtggggcagggaagacagaagccagtaagcacatcatgcagtacatcgctgctgtcaccaatccaagccagagggctgaggtggagaggtgagtggcaatgggcagctctgggcctcagcatggcaggccagggacctcagtgtggcaggaagggctggctctggggagtgagagacggcaactggagtctagctcaggtcaagttcagtgggaacttgggaagtttccagataatgccaacacacccggaggtgagacagggtgacccatgccaaggacctctccttgggtgggtgagacctagccaaggtactgggcctaccagctgggaggaggcagcagccacaggtaggatgaggagaagtgcagcagggcccagagatgcttgaaatggctcatggacagggcagcaggcagattccatggaaacctggagaagctggcaggccctggccaagatggccaagcatgccaggtggctgtgtgggtgatggccaggagccttgaaaccaggaaacctgtcccttatggaagcagcttcctctgtcagtgcctgtctcttcctatcaagaggcagcgagatgggattcaggggggacaagcaatgtcagttcctgagcacatatggccagcaccactgcccacccctgcagctggaggtctaaagcccagtggtcagaacagcccctcctccccaggctgcagctgaggcctgggaggggaagaggtggctgtgagaaacaaggacctcaatgctacacagaccatgctgagcacagccagcccggcaagtgcatttcccagcctctcagaggtgaagtgaccgtcacacaacctcagaggcaacactgggcgaggccaggccattggttccctctcagcaagttcagaggaactcatcctgagatgctgtgatttctgttgggaagactcaggggcagagacagcattccccagatgggaagtctttgccttaagacccagcccctctgccctgacagggtcaaggacgtgctgctcaagtccacctgtgtgctggaggcctttggcaatgcccgcaccaaccgcaatcacaactccagccgctttggcaagtacatggacatcaactttgacttcaagggggacccgatcggaggacacatccacagctacctactggagaaggtgggcaggtgggctgaggagacctccatggggagccctggccgagacccatcccaggcctgggaaggtacccatcccgacggtgcagcttaggagggctgggctgtctctccctgtggcccttctctgggcctcagtgtcctcatagtcaggactctctgacccccagcctgccttgcacctgggaatgttcagatggggtccccagggtcagactccttcccaggcctgagtccatctgcccctctctcctcagtctcgggtcctcaagcagcacgtgggtgaaagaaacttccacgccttctaccaagtaagccctgagggcaaggggaggtggaaaaatggggtggggaaagggagggcagcaagctggaccagcttgtgacccttccatcactaccccaattccccctctctgcccactcaaccccacctagcccatcgtcctcactccccaccacactcaccccaaccagtaccccacaccccacaaacaagagggtgtgacttgcagggaacaaaagcaggatgtcccctttatctgagacacctccagatgagggctctctgggacccataagtgtctctgtgaacaataagctccccacgaggtgggcttcccctgggattacaggcagtgtctctagtggtatcagagctcaacactgaagtggtgctcctggggacacgggcattgactctgagcacctctgtgagataggcgcgcccagggactgtctccacaagctttgacaccccactgaggtgggagctccctggaaacaaacagtgtctctgcagtctcagagcttgacactgaagtggagctccctggcacgccagcggtgtgtttgcaaactgtggcctgcccactgtgtcctctggttcacagacagtgtttccacagactccgaactcccccactgaactgggagcaccctatgactggagcagtgtctctagggacttggagctccccactgagttaggagttccctgcagcacagacatggtccccaccaactctcagctccccagtgcagtgggagctccctggaacacagcagtttctccctggtacacaggcggtgtttccatggattctgagctctttactgaggtgggagctccctgagacaagcacagtgtctcacagactctgtgctccccatgagacaggagctccctgggtagcgggcagggtctccagggtctatgaaccgcccgctgaggtgggagcctcctgggatgcaaggagtgcctttaaggactctgagcttccatggtgtggtgctccctgggacacggcagtgtcttcacgactctgacttcccactgaagtcacactctctgggacacagcagtgtctgtaaggactctgaactccactgaggtgggagccccctgggctgtctttccagtgagtctgcactgaggtgggagctcactgggaaaccagtagtgtctctgtggactctgacctttatttgaggtaaaagctccctgagacactggcagtgtctccacagactctgagcctccccctggtgggagcccctgggaacacagagggcgtctccacagactctgagctctcactgaaatgaagctccctgggactccggcaggatctccacagactcttacctccccactgaaatgggagattttgggacatgggcagggtctccatggactcagagttcccccattgaagggggagttcggtggcacatgggcattgtctctaatgactctgagctcctggctgaggggattgctccctgggacgttgccagggtctccacagactctgagctccccatgaggtgggagctccacaggatttgggcagggtctccatgaactataaactctccactgaggtgggagctccctgggacacagagagtttttttcagactctgaactcccatgaaatggagctctttggagcatggacagtgtctttaaggactctgagctacccaccgaggtgggagctcagtgggacatgtgaagcagtgtctccacggactctgggctgcccactcaggtgggctgtgtcttggacacaggcagtgtctctatcaactttgggctctgctctgaggtaagagccccctgggacaggggcactatctccttggactttgaactcccaccaaagtggagctcactgggacagtggcaacgtctccacggattctgagctcccgctgaagtggagctccctgggaatcagtcagtgtccaagaactctgagcttccctgaggtgggagccctctggaacacaaggagtgtccacgcagactctgagtttccatgaagtagggctgtctgggacactggcggtgtctctatggtctctgagctcctcacggagctgggagctccctcggacatgggcgatgtctccacaaactctccattcccctatgaggtggaagctctctgcgacatgaccattgtctctgtggaatctgagcttcccactagtgggagccccttgggacacagggcagggtctccacagactctaagctcccactgaagtggagctctctggaataacagcaggatctccacagactcttaccacctccagtgaagtgggaacttttgggacacaggcagtgtctccatggactctgagctccctgctgaggtgggagttcatgtggcaccagttgtgtctccacagacgctgagctccctaggacatgggctctccctgggtggagagcaatgtctccacggaacctgtgctccctactgaggtgggagcttcctgggacaggggcagggtctccagtaactctgagctcccactgaagtggagctccctaggattctgcagtttgtccacaaactcttacctcctcactcagtgggaggttttgggacccgggtagtgtctccacatactctgagctacccactgaggtgggatccccctgggtcgagggcaatgtctccacagggactgagctccctaccaagatgaggtctggcacaagaacagtgacttcatggtggagtcatagctcccactgaagtggagctccctgacccactgaacagctgaatggggagcttgctggcacacagaaactgttcacactgtctgaccttcccccacgtttgttcgttcaatactggaaggaagcgcaagtctgtttgttctcctgcctgtgtgtgtgtacagggggacatcctgggagcttatttgtctaaaggatgcctgtgtcctctagttgctgagaggcagtgaggacaagcagctgcatgaactgcacttggagagaaaccctgctgtatacaatttcacacaccagggagcaggactcaacatgactgtgcacagtgtgagtgtgaggggcaccaagggctcaaactgggctcagtgtcagggcctgagtgtggtggtagggaatgggcagcactcagcacaggccagggtgaagtgaactgtttgcgtgagtggggagggtgctcggggtggagtgaaaatggctgatggaggggacagagtgcaggggtgagcaggtgcttaggctggagtaatcaggttcaggaaggggacaggggacaggggtgagcaggtgcctaggatggaggaatcaagcctcaagggagacaggtgtcctgggcccagtgtggctttggagtgatgaatcccttctaccctaggccttggacagtgatgagcagagccaccaggcagtgaccgaggccatgagggtcatcggcttcagtcctgaagaggtggagtctgtgcatcgcatcctggctgccatattgcacctggtgagcctggctcagaagcctgggagggctacttccccacaagggtttcctggctgggaagcacccagggatgaggaggagactggctggagatgccccagcaatgtgctaggctgactgcctctcctgcagaagctgagctgctcgagtgatgagctcagttgatacatggtccagaccccattcttagggccaggtcagccaggcgcagtaaaagctgagcatcatgcagactgcctcttagtgcagtcatgagctgtgtggctttggttgcatttactcagtgcctcttggcctcagttctctctaagcggcatgaggagtaagtagtgcagggctccgctggctgtgggaggatgcgatggggtcattcacatgtcatttggactcgaggcctcgaggccttggcagagactctggtgtgcccatgcccccttcccccagtctctggctgtgtctgtgcccatggtgagcagctgaccatgctggtctgagaaggagctgtactctaccgcatccatgtcccctgctttccttcctccttcttgtccaaagttgtccaggctcttttgagacatggagcccggactgttcatggttttcccatcaccagggaaacatcgagtttgtggagacggaggagggtgggctgcagaaggagggcctggcagtggccgaggaggcactggtggaccatgtggctgagctgacggccacaccccgggacctcgtgctccgctccctgctggctcgcacagttgcctcgggaggcagggaactcatagagaagggccacactgcagctgaggccagctatgcccgggatgcctgtgccaaggtactttgggggcaggcacagggagggaagcccaggaggccttcatgggggaggccaggccagaggcagcaggaagcagggtgttcctatcccccaggcagtgtaccagcggctgtttgagtgggtggtgaacaggatcaacagtgtcatggaaccccggggccgggatcctcggcgtgatggcaaggacacagtcattggcgtgctggacatctatggcttcgaggtgtttcccgtcaacaggtgggtggctggccagccacatctccacctctgacacccagcagctttgcccacttagttctggaaagctcggctggggctgggcagcaggaatgttggggtttctcccggctggtccctgggcccaaggctcatgcctcccaaacctgcctcacctgcaccctctgaccattgatgtcctgatggaaggcagaattacggggcatgagtaattcctggttgtgactcccaagtccactccagaacgtgcatgcaggaggtgtgggtggggtaaaggagtccagggcagggatgcataagccacagggaagccacacagggtgctggcaccagaaccctcaatgaacattagcagagatgttcaggggagcagccacccattaccatgcactccacaagcagcgacctcccctctgaaaggcccaccccacccccagtttcgagcagttctgcatcaactactgcaacgagaagctgcagcagctattcatccagctcatcctgaagcaggaacaggaagagtacgagcgcgagggcatcacctggcagagcgtgagcactgtggcctggagggaggccaggcagtggggtgtggaggggcctcagcccatggggaggggcccgggctggcctgacaggtggctgagtgtggggcggaggaggggaggtggcctgaaagaccttgggagcttccttgctggctgcctttgccccaggttgagtatttcaacaacgccaccattgtggatctggtggagcggccccaccgtggcatcctggccgtgctggacgaggcctgcagctctgctggcaccatcactgaccgaatcttcctgcagaccctggacatgcaccaccgccatcacctacactacaccagccgccaggtgcccccggctgtcccagtgccaccacagtgggctggtgggacctgccccacaggcaccatgctgcccatgcctcgtggggcctggttggggacccagctttggtgccattgtcgtcactgtggcaaccttctctgccctggaggtggggaggcagggctatcccttcatacagaccctccacataccttttgtgccttgacctcagcctgtccccatagctctgccccacagacaagaccatggagtttggccgagacttccggatcaagcactatgcaggggacgtcacgtaagggccccctcccacccacatccctggctttcccacaggcaccatggcatgtgtcatggggcaggagcgcttcaggggagtggctcggagacaggtgttatggccacttctgccacccccacccctttaagacactgaaacatgccggacagcagattcacaagtgaagagcaggaaacagggtttgaggatagtggttaaccatggctgcattcttctgggagcctttaaaaaatacccacgtctcatgtctgggcccaaccctataccagcatctgtggggtggggggcttcaggctggtgatgtgggggtggggagggagtggaaggtgcaggggggccaagattctgcatttctaacaagctcccaggtgaggcctcgctaccatacttggaccacgctcccagtgccaaagcccaggtgtcttcaggggttgtcatgatggctattaacttatgtgttgcttgccgcatcccaaaacgatttaaggtgactcacatcaaggtataagtgtttcatgagaacttctcaaggagagggaatagaatagatgatgacaacaaagcagcccaatatcatctacctttatctgttcgcaaaatctacacccatgaggtcgctcatgcctgtaaccccagcactttgggaggccaaagtgggtggatcacctgaggccaagagttcgagaccagcctggccaacatggcaaaacctcatctgtactaaaaatataaaaattatccgggcacgatgacgcgtgcctgtaatgccagttgctcgggaggctgaggcacaagaactgcttgaacctgggaggtagaggttgtggcgaactgagatcgcaccactgcactccagcctgggcaagagagtgagactatttctcaaaaaaaaaaaaaaaaaatccattccctgagccttcataggtgctgcagttggagccaagatttggcactgacctttctagcagtccaagaactagacagtgattctgaggctctcagtgcccacagatcaaaataggcccaggactcaggagttcctagtcatagttgtagtcgctgatgtttatcaaaattcagtaggcactgttctgagcaactgatgtacactgaagcacagagaggttgagtggcttaggcaaagtcacacagcatgcatgtggtagaagcaggactcggtgctaggacatttggcttcagagctgggggcttaaccactcgattcatcttccaggagagaaatgtctcctgagggagggagtcttacatgacgaaagagaaagcaggtgtgagggggaaggaggagaggagccaaggcagagggaggaagagagactgacctatgggaacagaggcagatgggaagagagtgggggctgctggggtcattagcactctggcctggcagcccccgcccctgctccctcaccagccctggcttctggtaggtactccgtggaaggcttcatcgacaagaacagagatttcctcttccaggacttcaagcggctgctgtacaacaggtgagcacggcttgctgggcaccatagggagggccagggccctggggccccagagactctggggtcaggcattgactagcgtcaggacgtgggtgggtggggctgctctcccagaggatggctgggaattcggcctgtgtctgcagcacggaccccactctacgggccatgtggccggacgggcagcaggacatcacagaggtgaccaagcgccccctgacggctggcacactcttcaagaactccatggtggccctggtggagaaccttgcctccaaggtatgttccacccctctcccactctggctgttccggatccttctctctgtgccctcggtgccaagtagggtcccaaccacctctgtacatcatagtggtggggagagggttcttgtcctgtctgtatgagccacatctgctccagcagtggaccccacccactgcacaggtgagatgtggggcctcaggggctgggctgaggcttgatcaatcatggggaacccaggcttctcctcgccccattgtctcttgaacagggaggggtttggggagaccctgctgagaggctggcttggcccagcccagctcttggcaaaaacccaggattcttctggcaggtggggccagagagacaggaaactggcacaagctttcttggggagctttgggtcaaaagtcagaagaggaacaggtgaagggtcagggagaggacatgttagggtgagcttaactacagaacatccagagatgtcagccccttttggaaggagagaaggaaggcagatggggcgaggcctgctcctgcccctgccacgcccacctccccaccccccgaccaggggctggaacctggctctgaacctggccttgctggcctctgcccagcacttagggcttccagggcccttgttctgctgatttcccttctttgttcccaactcttctcctggcctgggaccttgaggggttaggaagcccctggtgtggggcagggtgcacagtgctgctggcgcagaccctctccaagtcccctctgtccctgcaggagcccttctacgtccgctgcatcaagcccaatgaggacaaggtagctgggaagctggatgagaaccactgtcgccaccaggtcgcatacctggggctgctggagaatgtgagggtccgcagggctggcttcgcttcccgccagccctactctcgattcctgctcaggtactggcacctgacacccatcactccatgggccatagtccctgtgtggagtccaaggggtaggagcagagggtccccaaacagcacgtcgcaaacatcgatacaagcaggaaccagcacgctgctggcctcaagacaccaaaatatctgggaagacatgtgtgtgagcacatgcatgtggggacatacaggtgggaacatgggtatgagggctgtgtgaggacatgtatgtgaggacatgtgtatgggaagacatatgtgcacaggtgtcataagtgctccaggaacacactctgtatccctgccatctccccaggtgtggggtgggcagggtgggctccatcatctctcccccaggcctgggccacactgccctgtcctgtggtgacaggtacaagatgacctgtgaatacacatggcccaaccacctgctgggctccgacaaggcagccgtgagcgctctcctggagcagcacgggctgcagggggacgtggcctttggccacagcaagctgttcatccgctcaccccggacactggtcacactggagcagagccgagcccgcctcatccccatcattgtgctgctattgcagaaggtgaggtgggcggggcaggaagacatccactatggaggtggggaaagcttgtgtcccaggggccacaaacacacttgtaagtttcacaggagtctctgcttgatggagacaggccagggagtgctcaataaatgctcagggccaggtttgggtctaagggttagggcctgattgaatttgactgcgtatcccatcccacctggcccacccaggcatggcggggcaccttggcgaggtggcgctgccggaggctgagggctatctacaccatcatgcgctggttccggagacacaaggtgcgggctcacctggctgagctgcagcggcgattccaggctgcaaggcagccgccactctacgggcgtgaccttgtgtggccgctgccccctgctgtgctgcagcccttccaggacacctgccacgcactcttctgcaggtactactctcagcccaccacacattccattcagctggcatccactgaataccttaacccatcatcccgggcctgcagtgcctggatgggagatacaccagcccccttgataggtgggaaggtggatgctatgccacattagctgactgctcatgtcccacagttggtgcagagccctgaccatcttgggtactgtggtgggcattcaaggtccagggctgcagcctgcagggggaggcccattagggctgggaagtaaggggattctgcatctgagcggggtcttgagggctgagtaggagttctccagaaggaggggcacagagcatgctcagaacaggaggacactgggcgactgctggtccctgggtcaccttccaggaacaagcgttaggcacaaggggccaaggccagagaggccggcagaggttgggacatgaaaggcaggcagcaccaggctgagggctcagcttcctctgtggagagggggctcagggagcacatgaacacatggccagcatctgtctgactacatgccctctcccaggtggcgggcccggcagctggtgaagaacatccccccttcagacatgccccagatcaaggccaaggtggccgccatgggggccctgcaagggcttcgtcaggactggggctgccgacgggcctgggcccgagactacctgtcctctgtaagtgccaggcgagtccagggctgccagggggaagtgggctgccaaagagggctctcggctaatgctgtgaccaggtcccctcagatgtcctctcccaggcctggggttgtctgtcctggtggccctgtacctcagcccccaccagagctctgcaaggtctcatcctgggcttcaggagcagtggccttcgggggtgggtgtggatgacaggagggccaggctcagatgcagcctagaagtcaacacaagagggctctgtgccctcaggaaatccagggctgctcagctcacgcacaagtctgtgtgactcagtttcccgagatgaaggatagctatgctgattcacagacagctgctatcaattgagtctggtcccatgactcaatcccaagcagcgccccctcccctccatctgtcctcaggccactgacaatcccacagcatcaagcctgtttgctcagcgactaaagacacttcaggacaaagatggcttcggggctgtgctcttttcaagccatgtccgcaaggttagacaagggacaaggatggcttcagggctgtgctctttttctagccacgtctgcaaggttagaagctggtgcagagttttgggggggcacttgggagaaaatggaggcaaccccagcccaggcccagctgctcctgacactcccaaaactgtcgccagcggggaggggaggcagtagggactgccgaagcctggggccctggtgggtgacagggcagcaccagcctgggtccagccacctctcccacaggtgaaccgcttccacaagatccggaaccgggccctcctgctcacagaccagcacctctacaagctggaccctgaccggcagtaccgggtgatgcgggccgtgccccttgaggcggtgagcaatgtgggtggggagtagggtgcagcatctgtgaggggcactgctgggctgctcagagtcctgcctcagtcttctctcccctgtttacctgagatggcccagaccatcctaaaactcagcgatggtggcacccgtgctgaaaatcctgcagtggcttcccacgcccacagagtgaaaggtcccatcctgtgatccccaccagcccagtcaccccccacccccactctcacactctagccaagccaaatggtcccctcttccaacttgtgcccaactggggttctcccacctgggcattctgggacctgagtacccaccacaatgttctgggcctcctgtgggataccgtcccggccactccggaaccttctgccgagctctgtggcctacttgctcccttcattagcagctgctgttcccataaattctctttcccacaagacgggggtagggatcaaggccaggctacctctgggtctcccacagtttcaggggtcccatgactgtcccaatagaaagggcggtgagtgccttgctgtgtaatgccacagcccaaagccggcgtggttgtttaaatgcagtgaaagtgacctagaactaaaaacggctcctccaggcagtagcacatgcaagggcttagcatccacaggtgagcagtggcggccctgttggacagcaaggatctagaaccatcagtcctggagaaaatcgtattgtgcagcgtcccgcccaagcttccccctgtcagcagggccccgagagggaggagggggcggtggggggctggtggccctggcgagggcggcgctccccgggtgcggttgggggttcggcagaggcttcctggggagggggtgagtccggctaggctggggtgcgggttgaggcggctgcactctgaccccgcgctccgctcaggtgacggggctgagcgtgaccagcggaggagaccagctggtggtgctgcacgcccgcggccaggacgacctcgtggtgtgcctgcaccgctcccggccgccattggacaaccgcgttggggagctggtgggcgtgctggccgcacactgccaggggtgagtgcaggctgggcggtagcgggcacgaagccccggccgcgtggccgccctgacccctcctcctgccgcagggagggccgcaccctggaggttcgcgtctccgactgcatcccactaagccatcgcggggtccggcgcctcatctccgtggagcccaggccggagcagccagagcccgatttccgctgcgctcgcggctccttcaccctgctctggcccagccgctgagcgcccgcacccgccgcaccccgaggccgccaattgtccgccccgccagcgctgcaaataaaccttctgagtcagcc

SEQ ID NO: 29 - DNA, 15494 bp, Homo sapiens
gccctctagggtagaatccgccaagctttgagagaaggctgtgactgctgtgctctgggcgccagctcgctccagggagtgatgggaatcctgtcattcttacctgtccttgccactgagagtgactgggctgactgcaagtccccccagccttggggtcatatgcttctgtggacagctgtgctattcctgggtgagtcagggcccccaggagggagagaggaacgggaacctcagttggggataaccctgggcaaggatgaggggtggcatgggaagaccgtcaggacacccaggggagggaaggcaggctggtgaagatgaaaccctgatgactctgctggctttggaaagtcatccaatgtggcagagttcagggttttttcagtgtctttcacccaatcttactgaacacccagactcttgatgttctgttgctttccacatcagaacccgctctgagaaaagtctagtaacctatacttgaatgataaatgaatggccagagtgtttgccttctttgaaatttatgcttcacaaaagaccaaatcttaggcaggagggccagtgctgccttgggtaaggggtagggaggaagttgtaagatgcatttttgggaggaggtggcagtggccattctctgtgcccctgaaaccactttgtgtagcagaagcctattgtcttcatgtgtaagaatattcccctaggcagaagcacagggagatctgggttatccagggaaaagggactctgagaatacaaaaacctgggtaagtctggagtcatctgttgtgggaccagagaaatcatgcatgctgcttttgaccacacagaccatgatggggaagtactgcatctgatcagcaagagagacagggtctttggccaaaatggagggctcttttctaaccatgttctcagctgttggataggggacgacgactgattttgctgagtggtttgaaaagcctaggggaggccaagtaggggagacttactgccaggactatctctccaagctcagttcctggggcttccaccctcacattctagaggaaagcatattgccactcagccaagttgtgtgatgtgattactagtgaaacgtgatcagctctgggggccctcggctcttggctgtcaatgcaggatgatactgggctacaggagaaagaggtaaggaagacagagtattcccccatgaataggatggaatggattaaagtagaagagaaagtaaagtgaactacctcatttgtcatgtggggaagttcaggcctagagaggtgatgtgcttctctaccacctgggcaagactcctgggaaagatctttggtattttttcccatttgccttttactaagtcatcaaagatttaccccattttttccattcttattggggctgccacatttacgtcttcatcacttgataactcaatttttatagcaccctctgatggggtcttgattgatcctgtctcccctcccctgcatccatgctgcccaccaaggccacggcatcttcaggtccagctatggctgtgtcagtgcatttaataaatgccttccgtgctgctccattgcccactgcaaaaactctaattctgccctgcacactgtgttctccattgcaccccacatgaatcttcttctacagccaggcagtatgtacactgcactttctgtttttaccacctttgctcctgctgactctccaaattctatgtgcaggcactgttctaggacttggagacttatcagtgaacatgactgacagccttcctgaccggaaatacgaggtcaatgaacttattgtgaagcaataagtacaccgggtgggaggatatttggtatttactactatttattaactgtggaatggatacataattggtgacttctctctcctttcctcatcttttccttttttttctctcgctcttcctcttcttttttactctctctcccactacaccgtcccccttgccaatcttacatactcaggtttttagctaccacttctatgtcaataactcctaaacctatttctcttgcttgcttctgtcaagtataattttatatttccactgctggttggacacctctaaaatgattctccagctcaaaaacaaagcatattcaaaatgcaacttatcatctcctccttacaaatgttctcttcctcctaacatttgtatttgcgtaagcgcagccacccttttcctagttatccaacttaaatcacccccacagtctattaaatgccaacttctctctgccacttaaatttcttctgcatctgtttcctcttcttcacctcctattgtcagtacaactttgggctctcttatctcccacctagattcaaccagtgaatgatttccagagcaatggcacatcaaattaatatggctactgctctctttgaatttatattctactgagggatataaacggtaagtaaacaaacaagaaggcataagtacaaatggaaaagggctatgaagatgtaaacggggtactgtgataagattagttgtggggaagagaagagagcagcccactttaaacaggatgttatgtaaagagttttctgagggggtgacatttaagctgagactttcaacatggtaaggattcagccatttggtgatcaaggacgcatttcagggtagagggattggcatacagaaaatccccaaatttgaagaatgccaggaaggccagtgttaatgaggctcaatgagtaggtgaaaagggatctgagctgaggctggagaaggaagcacggacccaatttgatagggcttgcaggccatttccattttattttaagaccaaagaaaggcaactgaaggcttgtaagttggggagtgatatcatctgatttcgttttttttttttttttaaggaactagcttctttatggaaaatggattgtagggtgaccataagaagtgaggggacaaattaagatatgggaaaaagctgatggtgacttaaactgagtagtgtctataaagggggtgaagagaagttagtgggtgcaagatctaagttggaagcaggatcaacaagacttcctggtgtggaagggactggattttgggagacagagaggttaaaagatggcttgcaggtttctggcctatgtagctgggtggataacgaagatacatattgacatggggaagacggagagaaacagaatgtgtccacttgctatgacaacatgaagccattggtgattttgacaagaaaagttttagtggactgctgagggccgagtccaaattgcagagaattagacagtgaatgagaggagaagaaatcaggacagcctatgtaagaaaaacaatggagaaatttagttttgaaagggatgagacaggccaggcacagtggctcatgcctgtaatcccaacacttggagaggccgaggtgggtggatcacttaaggtcaggagttcaagaccagcttggccaacatggtgaaacaccatctctactaaaaatacaaaaattagccggatgtggtggtaatacaaaagttagccgggcgtggtggtgcatgcctgtaatcccagctgcttgggaagctgaggcaggagaattgcttgaatctgggaggcggaggtcgtagtgcactgagatggtgccgctgcactccagcctgggtgaagcaaacaacaacaacaacaaaaaccgagagaaatggggcagtagctggaattatatgtggtgtcaaggaaaagtttttttttgttttttgtttttaatggaagatactgaaataaatttaccattgatgggaagatccagctaagagagaaactggtgatgcagaggagaaagtgaataacagaaagggaaatctttgagaggattaaagggaatgggatccagagtacttgctttgagactgaccatagacaggaggagagatgctttctccagtgaaatgcgaggaaggagaagacaggtagagatgcagaaaagactggtagatttagtcgggggacgatgtgagatcttctgtgtaacctcttttgttttctctgtgaaatatgaggaaaggcatcagctaaaaatgagagaggactggaggcagagggtgggatgagaaagcttggggaatgaggaaaagatgagtgtcactactcagagtagcagagcaaatttcttggaaaaaagtgccacaatggcagttcagtgtccttttgaatgcggtgatcgcacatttactgcgtcaacagtttgccttcttgtgtggtaatttcaataacacgcagctgagcaagtaaaggcatggcgaatacaggtgcatttggtagagacagagaaaggcaacgaagttaaggggatttgcaaggaggtaattataatgatgcctcattgaattcaagctagatgggggagggtgggaggtaaaggcaaacatgtgctcaaggataggcagtggtaagatggatgctttggggttcttgataaggtcaaagattattctggtggctgtacttgagcagagaaagttcatctccaaagaaagaaagtttactgatgatgagcagttcagggaatgaagaggccagttgtttgatgggttatccacatattctggatcactacagtcatctcttttttttttctttttctttttctctgacctcattcttccatcacaattagtttctttcttaattaagctctttggcatttgccctgttccaatctatttgacactgcactttcagccccaatttgaaaattctaagtgacttcccactgtatactgaaccaaggagtgaacttataaaaaaaaacttaaatttatttgaaattcaccatgtgtcatgtagcacactaaatgccttctctggattatctcatttaatcctaacaaccaccctatgaggtagatactgctgtcattatcttcatttacaagcaaggaaactgaagcagagaaaagttaagtaatttgtgaaaggtcacttagcagtagcggagtcagcatttaaactcagtatgtgctttcccccactgccacaccacctggcactaggagccctccagagtatgacttctaccttgctttcctgctttgtccctcattattggaagtgcttgaggagagaccagaaatcaagtagaagttgggctgcaacttgctgggaatgttgccaagtacttgctgctccttcccatggaataccttttccctctcagccaaaatcctatcagtcctggaaggtccttgatgaacctgaaaggtcccatcttctccataggattcccctccttatgaaccccaaaccctcccaaacacagagccctgggatcttttctttctctgaacctccatagcattttatccaaattcctctaatgtcatctcttttacatcagattacacatgtgcttatctccaccgttagattcttgccttcagtggaagtagggacttaacgttcttttcccttaggtgaactcagcatgcattgcagggcagtaggaagccaatgcaggtttgttgattaattttggatgcaaaggaaggaagtgattggtccaagtgtatatttcgagatattggagcatcgggaccagaatccagttctgtaaactttgaagccaacactttctccacattgctccctttttacctcttggttctgattccatttccttccgtacttttgtccctgaaaatatacatgcacttggaagcttcttgactttctctcagcccagatgcaagagaaaaccttcacccatggacagatggacacacacacacatacacacacacacacacacagagctctgattcacctaaggacccagctttgcttctttacccaataacagcacccacaaatctttatctaccctagcccacactttgcctccactacggaagctcttttcttaacccagtggcatccccctacccctgcatgaagtcacagatctagtgcccttttgcagtctcttcttccttttatcagatatttctaatagcaaaaatctggaagacctaaatgccaagcaaaagagttgttaaataaatcacaggacagccaaatagtaggatatagtgtagccatttaaaatgacaacatgggcggggaacggtggctcacacctgtaatcccagaattttgggaggctgaggtgggtagatcacttgaggtcaggagttccagaccagcctggccaacatggtgaaaccccttctctactaaaaatacaaaacttagctgggtgtggtggcgcgggcctgtaatcccagctcttgggaggctgaggcaggtgaatcacttgaacctgggaggcggaggttgcagtgagccaagatcgcgttattgcactccagcctgggtgacagagtgagaccctgtccccccacaaaataaaataaaataaaataaaataaaataaaataaaataaaataaaatgacaacatagaaacagattcatcttctagaacttgcattgctcagtgaagaatcaggttaaagaacagtttttagagtatatcctcatttacacttatgtatgtctgtatgtgaacagcgtgtgtctgtgtgtgatcacagaaagaaatccaacaggatgtatgccaaggtgataatattttgctcctgcgtattttctatttttctgtagtgatcatggattacctgtgcaatttctaccccctcccaacaaaagaacaaatcttgctctcaggataaactctggcaaaattatttatactgatgcataaatcatatgtaaagcccaacagagacctctttccagaggcatatttattttaatcagtcaagaggggtaagccaaaggaaaatgccacaaaacaggtggaagagggtgttatatacttttatttcatttttgtatgttactgggagttctcagtccttttaaaagtgcagctcatccaggcagtcccaggggatatggccacgagggctgtgctgtaggtgaagggcgctctgggcctgggcagtctctgggccaaagtgggcaggtgtcagttcagacactccactgtgggctgatctttgctttctgtcttacagctcctgttgctgggacacctggtaagtactccacccacagcctttccttccctcgggtccccttttcctctcctcccagtgccctgtctggaggtgctctaaatgcaccagcaactgagcccagtaccaagtcagggccaggaaagggtaattgctcccgaaagatcccctctccctcttccactctcctccttccttttcctccttccacggaggcaagtggtaggcagccacggtgttcaaatgggggagctgtcacagaaaatgagaactctgatctctctctcaactgccttccgctgtccaaataaaaccaagggcttcctctctccaaataaaattcaggcacatgcaaaatcacatggcctgcatatgttgtccccctgtgttgctaaatccttgactgtgcatgtttctgagagctccaaggcctgttccctgacagagtggtctctgcatacctctggctacactttgccgggcacttctgtgtttgtgccactcagcctccaccgctccaggactggccctccggcttttctccctctctctttatccttctgaggccagagaggctcgtgtatgcttgggtgtgaggacgggccatcttgacctcgtttttaaagtatacagaatgacattaggtcagaacggaaacctgatatccaactcccatgcctgccatctccaccagagcccccacttatcttcagccagccccaggggaaatttatccactagtgtctaaatgcctttgtttatcggggagaaaagttagtctcgaaagagtatgtatgtatggggtgtctgtgtgtctgtgctggtggggagaggttggtggggagagagagaaagaactggtgaggatatctcaggtaaagtatatgtatttcgagggtgtttctcttgcctgctccctccttcttccctgttgccctgtcggagtcctgggctccctggggccgttgtggtgggatgtatgagcaaaagcaactgccttcagttgcagaaccattctgggcctggctcggcttttggtgcccctagtaggcctacaggtgcttttttgtctgagattcagggcctctcaagctcctgggcttcctcttcttcatgctacctcctctctctgcccctcagcagctcccccaaaggctgtgctgaaactcgagccccagtggatcaacgtgctccaggaggactctgtgactctgacatgccgggggactcacagccctgagagcgactccattcagtggttccacaatgggaatctcattcccacccacacgcagcccagctacaggttcaaggccaacaacaatgacagcggggagtacacgtgccagactggccagaccagcctcagcgaccctgtgcatctgactgtgctttctggtcagtggaggaaggccccagggtggacctgggagggccaggacggatgaaatctgctttcaggcagaggtttgcaggaaaggggggtggcctgcttactgggaagtatcgctgtgagttgcctcagcacatatcagtggttgtttttgcctcagttctgattgaacagaagaaggtttcaaggccaaaaacaggcagccaagtgtgagagaagcagaaggaaatccctactgcataaaacccatttccattttaatggcagaattgaaaagcacagaccacaactgaatcctagccctggaaatgactcactatacaacatgatgaattcatttaacccttgagtttccatttcttcacctgctccgtggggcactaacgcctccctcagaggcttctggtgagaatcagtgtttccctgcccccgccccgccctccatgccccttctccacgttctcactgtgctaggtgctcttctctgtctttctcttccaccagcctgtgggaaacctgagatgaaagtcgtgtcttacccatctttgtatttccagcatctgaaactgggcagagcttaataaatattttgctggagaggttgatgatcttacaaagctcccattgaaaggtggctctctgtaaagcaaagttacaatgagattgtgatgaacattgtccttgtggcttttcacttagtcccctcccttcacctgaagagcaaattttcctcaaaagtacacagcaaacgaatgacccactggtgacactgctgcctttagaccctgctggaaagaagctccacatttattaacattcccgaagtaaatttatcaggtagcattcatcaggtaacatttgttgcacattcatgacttttctactgtccacaaaggcatatgtccttatcatatgcggactcctcggtcacactggattcttccttccctcctcgacatggaagagatggcatcttagggtctcttgtgttcttcctgcagaggcctgtcgggcaggaaaaggctgcagctgccttcctgggagaaggaggagatgagtgtatcctgaacacctattatgtgctaggggctattgtagatacatgacactatcatgctcattttcacgaatgaggaaactgaggctcagaagacttaaattatttgcccaagagttcataaatgacagagccagcattagagtccaggactgtctgatttcagacctaagctgttccctctgcacatcgtgtcccaccagtaaggaagatctgggtctcagagctgagccaagacctcccgggtcctctgcggttttttgtgtctttcagagtggctggtgctccagacccctcacctggagttccaggagggagaaaccatcgtgctgaggtgccacagctggaaggacaagcctctggtcaaggtcacattcttccagaatggaaaatccaagaaattttcccgttcggatcccaacttctccatcccacaagcaaaccacagtcacagtggtgattaccactgcacaggaaacataggctacacgctgtactcatccaagcctgtgaccatcactgtccaaggtatgcggagtctgccaagatgtaaggaggggagaagaggggatggacaagggctgaggtcacatgggcctacatggaggtctgagaaaggccacagcgcaaaattgggcactggagcaaagaggagtggtgtggaggcctggctaagtattgaccaatgagcaggagtaggggccagagcttggagccctcaggtgataggtgaccaggctgttgttccactttgaaatgcaggccccagactaaggacggcagcgaagcagagctccctcgttggtgcagaggttccctaagctcctgggcattcctaagaactgaggtttgcctttattcttctcatggctcatgttacagccattcactccagaaagcctggcacgtcatggaccgttcaaggctgtgctccatagagtaatgatgcctccagctatgcgaggctttgggcccacccttcccactgcccctgagggctaaggggagcccttccctctgttcctgcctgctcacaaatgtacctttattagtttggtggagaaacctcggtaagcaggaggcataagtccagccacagaaaccctgtgcagatgaggctggggatgtagtgagtgctgcagaagtgagtgactcagacacagaagagcttcgggtgacaagcactaggacatagcattggatgggggggaggtgggacaaggagagtactgcctgtcctgatgtctgtcttccctagctcccagctcttcaccgatggggatcattgtggctgtggtcactgggattgctgtagcggccattgttgctgctgtagtggccttgatctactgcaggaaaaagcggatttcaggtttgtagctcctcccggtccctttggttatcagtttccacttggcccaggccctaaccccagacattgccagaatccctctctttgggctagatacacattcagatctaggcccgtattgtattatagtcattcattcgtttattagatcattcatttgacaagacttgaacaaactagcttatgtgtcagccaatgcgtgagacatggtgggtgatgccaagagaagtccagtccctgcccttggggagttctcagcattgtgaggaagacagggtcattataataagatgggataagagcaatgatagggacatgaaaagcctaggatagaagtacagaggaggctccatagcccaacaagggctgaggcagttggagaaggtcttggggagagcagtgtagtgtagtgatggagtgcacatagtggggccagactgcctgagttcaaatctagttctacagcataccaactatatgacccaagtgagtcactccacctctctgtgcctcagctgtctcaagtggaaaatggggacactaataggacttacctcagagggttgccatggggatgaaagaggctgatgctcttacacagtgcctggtaggcagtaacagcacacaaacagggctgttgccattctggaggaggtggtgtgtgagggcagcgcttagctagggaaggaggaccctccaggcactgggccaaggcagggattgaagccgggtggggctcatatgggtgtcgaagggggagtagagagggtactgcaagccaccaagaaagaaagaatcctgctaacacctcacaaagcacttttcaattggttcatagccaacacctcagttactgatgataagtaaatacagagaaacagagagagagagactgagacacaggggtgtttttaaaaggcagagcaagcctcagacagatgccatggcgtggactttctgacactcctgggcatccccatgggtgagctgaattctgcctctggaccagcccttttccaggcgggagcagcctctgagcaggggagctgggggtgggaggacaggaaacatctgccagagtgaaggcctgagctggtcccatccaaccctggccctggtccttggtcctgaggactcaggccccaccgcctaatcctactaacctcctgtgtgcccctcccagctctcccaggataccctgagtgcagggaaatgggagagaccctccctgagaaaccaggtgagtacaggttgtctcagggattcagtgatggctcaccagggctgccggctggactggagccagggagaaggggcttgtgcaagttcagctgggagccagggagggagcagcagtgggaggatggctggggctcaaatcgcttggtcagctcttagtctaactcctgggcctaaagacgacctctctggagatgagaagagaaacaccagtcccagatacagaagagagggctgtgtccgaatttctggtaccaggaatctggtgatatttccagagcaagaaatcagagatactttggtcttcctgtggagctttggcagagctggcaaaggatggggttaggggctgtaagactgaggccaataggacgtgggaggcaggagtctaaggggaaaggaggaggaggcctggaaaccccttgatttgctgaggaatctgcctctgtggagggatggggtggagtggccaggctcagctgtctgtggaacactaggaggaggtttgggcttgagaaaattctgggggactaggggcactagtgggctctactctgtgggcaaaactcagttctgatgcccatgcactcaaggttgactgaattttggcctggttctgccctcatcacacagtggagccctgagcaagtcagtctccctgatggggttcagtctcctcactgaggaaatgagtgggtggccagggtgacctctcaggtcttctagatttgacattctgagaaccaggggccacccaagccctggcccaggtgggagtgtgtaaaggaacttccaggaggatgccaggcaacttccagactgtagttaaagtcagagcacaaaggaaaccagtgctttctctgggggcttccatgacagtaagaacaggcagaaaaaagaggctgtcaaagaccccacctcagatggctggagtatgattcagagcagagccaacagatttaagagcttgagcaaaatatcacttgttcagctgtgcttgcagcaaggtcgcatgtctgctggccaggcccagtggtgataggggcctgtgttcacaccagggccaaaacagatctggaaaaaacaaagtccaagcaactggattatccatcttgttgtgtggttctgtctgcactggcataagcacatttcacaaggcacttttgcagccaggcattggggctgcataaatggttttttaaaaatcctttcccaaaaggcaaagctgggttgctgggattcttgggaaatgtaatagaatgggaattcagaatgcggtttactgcagaatttacagcatggcaataaaggctctctatgttcagggggtgagagaagagactagatgcattgtctcagatgtctcctgacttcctgagaaatgccactttgcagatatggggctgcttttcacactggctaagtcagttcatggcaaaatatgagggaattcagtgtgtttcagacactaaccaaagtccatccttcctttctccttccgtccctcccttcctccctttctcactcactctctctttctttttaatgccatggagtaccatatttttcaaagttccaacaaagatgcactacatttagacaatgtggaaatggccctcagccttctctccctgaagtctgtggccagcaaaaatctggactttacttcactctgatgctgaacacccccctcccccacctcttccccaatatctcagatcccaagcctccctggtttgcttctaggaaagctcagcaattccctgaaaagaatgcagctcaagtgactgctccactttttcaccttggcctttgcggaaggctgtggctgggctaccctatgcatcgatcaatgaggtcatatttacccagtgcttggcctagaggcccaagacagggtcagcagtgcttgctttggctctagtttgggcgttggttttgcagcctcagcatcagcacaggcaggccctcttctccagcagtgctctggctgatatttcttctttttcccacagccaatcccactaatcctgatgaggctgacaaagttggggtgagtgatcccagccatctccccctcccttctcccctgttgccttttctgttgccttctttcctaggccctctctgtggatccttactgctggtttctgccttctctaggctgagaacacaatcacctattcacttctcatgcacccggatgctctggaagagcctgatgaccagaaccgtatttagtctccattgtcttgcattgggatttgagaagaaaatcagagagggaagatctggtatttcctggcctaaattccccttggggaggacagggagatgctgcagttccaaaagagaaggtttcttccagagtcatctacctgagtcctgaagctccctgtcctgaaagccacagacaatatggtcccaaataaccgactgcaccttctgtgcttcagctcttcttgacatcaaggctcttccgttccacatccacacagccaatccaattaatcaaaccactgttattaacagataatagcaacttgggaaatgcttatgttacaggttacgtgagaacaatcatgtaaatctatatgatttcagaaatgttaaaatagactaacctctaccagcacattaaaagtgattgtttctgggtgataaaattattgatgatttttattttctttatttttctataaagatcatatattacttttataataaaacattataaaaacaacattctgtttaccttttcaaggctgtattggttggagtgtagactgaactgcctggggtctgtttctcttcagtgatgagactcttaggaaggcaggaatggataggatagggggaggagaggagagatggggatttagaatgtagagtgagtgccccttttcttaaaactgaatacagtcacgcaccacataatgatgtttagttcaacaacagactgcatatatgatggtgatcccataaaattataataccatatttctattgtaccttttctattcctatgtttagatatatgagtacttaccattgtgttacaattgcctaaagtattcagtacagtagcatgctgtacaggtttgtagcctaggggcaataggctatacgctacagcctaggtgtgtagtaggccacaccatttaggtttgtataagtacctgctatgatgttcacacaacaaaattgcctgcatttctcaaaatgtatccccatatttcaacaatgcatgactgtactcttctgccaatgaccttgtattcttgtttccatgtcttcttctctttcctcctatggcaaataaaacactgttttgcaacacaa

SEQ ID NO: 30 - DNA, 162634 bp, Homo sapiens
ctgatttctcttcggctggacggaggctgcctcctcacgcggctcccaactattcccgtagctcagtgcccccctcccgccgctctactcagccaggcagacagactgacagactcgctagtgagtagcggcggcttgagcgcccgggcagcgcggcgggctgtcgccggcggtcttgtcttcccacgggctctgtgtgtgtgtgtgtgtgtgtgtgtgtgtgtgtgtgtgtgtgtgtaggatgtgcgtgtatgtgatgtgcgcgcagggggtgtccctgggattccacgcctgctccaagagctccctgccgggatccgcgtgtccatccgagtctgcgatgctgtgagggcgctcgcctaagcagggggttcggacgccccccgcgagcggcgagagtttgctgggattccccggctcctcacgcagcggctggtggggttccccgggaaggcgcctgggtaaggcagcggcggggaagcccgggattgtgagtggctggcaggccgggaatctgggagcgggtttggcccagcacagccgagggagatgccggagcggccacccttggccgcccagcctctctgcctttctcccttgcccttcctcctttcttttctcagcagcatcacaaaggcgcgctgcaaaatgaaacccagtgtagtgaagctcggctgtctcccacctggtgcatattccgccccccgtccttgccccaggctggaggagtggagtgggggtccccaagattaggggcggggtcttaccacgggggcacacctgttttcgattcttgctgaattcaagctgggtgcgggatcgcgagagaggttccagtacgccggtgtgtgtgtgtgtgtgtgtgtgtgtgtgtgtgtgtgtgtgtggccgcgcacgcgcacacgctccccaggcccacgctagcggggtgcgctcagtcaatagcacacctccccgccggcccgcgtgcgcccagccggctccgtgggctcctcgcgcgctctctgacagcgtgccgggatctctttgtttggttgtggcttccctagctctcggcaaagcagacggattttcggtttcgtttgataccgcgctctgggacttagtgcgggccacagcctcgaatgcccctggtatttgtaattgaagagttctttcggtcagggggttatttttggtgttgggaataaagaggcaagcatgttgacctttttgctgctgccttcggctttgaatgtgtgtctctggtggagcagacagattcaaatctagtcgcgcacacgtgccaacgcacaccagtgtgcacacacatttctacacacgtagtttacccccaccttcttttttccttttagaaaaattgggacagggaatacattgtgtgtctgtgaaaaagtttcctttgttcttttgggcattttctattttgagtaatggagtaggagtacggaaaggctgcagttagttcactcgattaaaagacactgcctctgagtcagagctgccaggttgataattattaacatataaaagcaaacgcaatgtttaaggcagaaggggcgggacgggggcaggtccgcggcagacaatgagggagagtctccgccgaccgcctgctgcttattgttccgggactggagactgcagccggctgctgcctagtcctccggggctccgctcctgactagctcctccgtccctctagggacggttcggggtcacctaaccctggtccccggggcgctgggacgctagccccaagccgcagccgctcttcgctgaccgccctctttctgctttgcaggtcggcagcttcactcccgagggtgccgcgagcccaggcggcgaacacccggtacccctggcgcagcgaggtgggatgctgtacggacagcagcgctaagtgcccccccacccccggcgcagggtgcactcgctcctggccgcgggcccagcggcggcggcggcggcggcggcggaggggatgagcccgggacgcgcgaggcgcctgcctcaagctaccgcccggagagggacgccgagtagggctcatcgcagtaccgcgcggacccctgccccctgtggcacgcggctgcggagccttgaagccgtgtctgtgatcaggatgcactgggcgcctcgcagctggtgaggatgccctgctgcgcggccctgcgcccccagccccagtcccaggtgggcaagactgactgggcccggcttcggcccctcgtgccggtggatgaaacgtgccggagtgcttgggtgccatcagctatcaaatctgaattctaagcgccatggacgaaggcactggactgcagcccggggcgggagagcagctggaggcgccggccactgcagaagctgtccaagagaggtgcgagccggagaccctcaggtctaagagtttaccggtcctcagcagcgcctcctgccggccaagcctcagtcccactagtggagacgccaacccggcctttggctgtgtggattcttcgggccaccaggagttgaagcaaggcccgaacccgttggcccccagtccctctgccccgtccacttcggcggggctcggggactgtaaccacagggtggacctcagcaaaaccttctcggtgtcctccgccttggccatgctccaggagagaaggtgcctctacgtggtcctcacggattcccgttgcttcctggtgtgcatgtgctttctgaccttcatccaggcgttaatggtctctgggtacctgagcagcgtaattaccaccattgaaaggcgctacagtctgaagagttccgagtcggggctgctggtcagctgctttgacatcgggaacctggtggtggtggtgttcgtcagctacttcggcggccggggtcggcggcccctgtggctggccgtgggtggactcctcatcgccttcggggcagccctcttcgccttacctcacttcatctcgcccccctaccagatccaagagttgaacgcctcggcccccaacgacggcctgtgtcagggtggcaactccaccgccactttggagcctccggcctgtccgaaggactcgggaggaaataatcactgggtctacgtggctttattcatttgcgcgcagattctcattggaatgggctccacacctatttataccctgggaccaacctacttagatgacaatgtcaagaaagaaaactcctccttgtacctaggtaagactttcctgttctctcagatatgtttcactcacactgaaacttactttccttacaaaaatcaaaaggaaacatgttctttcacattttcatgtatattatagattaaagttcactttattttacgttttagccttgctgtagtgtgttttcagtttgggagagaatcaattagttgagagttcttgaaactaattttcagactcatacttcatgtttgtcttttcccaagtaacataaactttaaactgtggggtgatgcttctctctgttgctacctacctatggaaaagctccaatttgtcaagtttatattctaatacacttgttgaggaaggaatagcagtacctcatgtgtaaagttttgatgattttctgcttctatctgctgctgcttctgatttctgtccagagcagcagggatggtggcgtggccagactacatacatcatgctttattgccttcatacctgtgtttcttttcttttttttttttttctttttaagatggagtcttgctctgtcacccaggctggagtgcaatggcatgatctcagctcactgcaacctccgcctcctgggttcaagtgattcttctgcctcagcccccgagtagctgggatcacaggtacccatcatgcctggctaatttttgtagagatggggtttcaccatgtttgtcaggctggtcttgaactcttgacctcaggtgatccaccctccttggtctcccaaagtgctgggattcatacctgtttttcttatacgtcacctgcaccactatctaaaaacaacaacaaaaatttgaataatgtcaaatgactggcttacctttatgaagaagcaacaccacaggttataaggtttatccaaagctatttttattgctgtcaaaaaccctcaattgtatgaacttgggagaagaatccattcctatttttctgaaaagccgtggctgtgggatttggtgtgttgacttgcataagtcagcatcagtggacaggggtgcttgagttaagtacagggggctcatctgaggccaggcagcagttgcagagggtatgaaaatttacatcctagaaatttgaggttgttagcacctccctgtagtagctggttcttaaaaactgaacttctaagggatggatttgaacccataagaaggatcaatggctgtcataccagatgagatttttgtttttctatttctgtactggagtgcaacctaaacaagctaaaggattttactttactgaaaaaactgaaatggaagctgggtgtggtggtgtgtgcctgtagtcccagctactcgggaggctgaggcaggaggattgcttgaacccagggacttgagaccagcctgggaaacatagtgagaccccatctcttaaaaaaattaaaatgataaataagcaaatactagctatatttagcaatttattagcaatgtgctgataggattcttgatttgggaatagtaagattttcaaaggacggtgtaaatgatatccaatataagagggctatgctttgtcctcagtatgtttactgtccccaaaagctgttatagaggggtgtttgagtcctcagtaatccccactaactggttcaatgggtcagaaaaagagttttataacttatttttatcactacatgcaagagaaagaaatttcctttctgggtagagaagaatagcttgcttaccatcttgcctctctgttttctaacatttattaagacaaaattttaaacatacagaaaagttgaaacaatagtataataagcaccagtatacccacgacacagacccaatgattgtttattttgtcatgcttgctttatcaacctgtgtgtgagtgtatatatgtatagaaatatattttgggagatgggaggctaagccttctaaaagtaattgcagacactgccagagcatcttctaaaaatgagggtattcttttacataactgaaggaacatcaacatcctaaggaagttcataatcattccctaatatcattaaatattcaggccatattcaaatttcctcaattgtcctctgaaagtcttttatactgattgattgattgagacagggtctttctttcacccaggctggagtgcagtggcacaatctcagctcactgcaacttctgcctcccagattcaagcaatcctcccacctcagcctctcaagtagctgggactagagacctgtgccaccgtgcccagctaattttttgtggagatagagtttcatcatgtttcccaggctaataataattttttaaatgaggaactaatcaagattcattcatgcattgcatttggctgttagccactttagccttctataatccagaactgtgcctcaacttttttctttttccatggcatagactttttgaaggggcaaggctaatgttccacattctagatgtatctgatcatttcctcatggtgtgacttaccttgttcctccattccctatatttcttgtatactagaagatcagtctagaggcttgatcaaattcagacaaaacatttttggtctgactatgtcagaggtaatgctgggtgttttatattacatgcaccttgctgttcattagtgacgttaagtttaatcatttggttgggtgagtgattggtgggtctttccattgtaaagatacatttctcattttgaaaataatgatcaatctgtacagtgatacctgggctctgtgtaaatatcccagttgtttttcatattcttgctgatctttgcctctatttactttgaaaacttggatctctctttcatcccacttttggtagcatcaatacagacttgctttgtcaaaattacaggcagaaccctatcgaaagggagaacatccactaacaacagccctgagatttaacttttctggtagtggttgcccatccagaagaaaaatagcaagtgcatatgaaatgcatattctgtgctaggtactctgctagttttgggaagaccaaaagtgagacacagtcccagcatttgaggtgtttttagtgtaaagcaataccgccagtgcaaggtaggggtggaaagtgacatgtgcaagggaaggaaaagaatagaaatggtattcattttctttcctccttcttttcttttcttttctttttttttttgagacgagtctcgctctgtcgcccaggctggagtgcagtggagcggtctcggctcactggaagctccgccttccaggttgacgccattctcctgcctcagcctcccgagtagctgggactacaggcgcccaccaccacgcccagctaattttttgtatttttagtagagacagggtttcaccatgttagccaggatggtctcaatctcctgacctcgtgatccacccgccttggcctcccaaagttttgggattacaggcgtgagccactgcacccggcccttcttttcttttttaaagatactgattaaattgctttttttttaaaaaaaaaaaaaatgatgaatgcgttagaacacattctttaagaaacctgggagaattctgctttctattaaatggatctcagtaggagctacagtagtttgagtatcagaaatcttagatatattatttcacttaatgttctcaatgaccttataagatggagattattttccctatgttacagatgaggaaacagtctcagagagtttaagtgacttactaagggcctcaaccccatgactttctgaccccagggccctcgagcttccttctacagtgcatggctctttggcaagaagccctgagaaccaactgtaaccgcaggatgtgccacgttcaacagagttttccaacagcgcagaagaatgcagaatgtagaattgccttaaagtcatcaaaacatgatcaaaataagattattctctaaaccgtttaaagtaggtttgatagactacctctgtacaaattagagactattatatccttagaacatgagcagtattgaccaattatgatgtgagacctttcccaataaataacgaattaaaatgtctttcttatttttcataaagctgttctattgcattacattttttgccacccaccccttccttaatcttcctgtccgtttttctaacttctcattataacctcagaggaaagaaaaaaatcaggtagtaggttagtaattacgagcagaaacaaatatctgcagcaacgtaaaaaccattgaaatggaatgtaattgtatatcttaatcttttgaaagttctatgttaacattctggcagctttaactgtagaagagatgtggtcgtagatgagatacggcagcatttatagccactaaatgccttaacttctgcaaggagagaggcttagaattgactaggagcatagagaaagctttgtaggtattaataagaagcaaggttagcaactagactataatttttttttctctttttttaaatattattatactttaagttttagggtacatgtgcacaatgtgcaggttagttacatatgtatacatgtgccatgctggtgtgctgcacccattaactcgtcatttagcattaggtatatctcctaaagctatccctcccccctccccccaccccacaacagtccccagagtgtgatgttcccctttctgtgtccatgtgttctcattgttcaatttccacctatgggtgagaatatgcggtgtttggtttcttgttcttgcgatagtttactgagaatgatgatttccagcttcatccatgtccctacaaaggacatgaactcatcattttatatggctgcatagtattccatggtgtatatgtgccacgttttcttaatccagtctatcattgttggacatttgggttggttccaagtctttgctattgtgaatagtgccacaataaacatacatgtgcatgtgtctttatagcagcatgatttacagtcctttgggtatatacccagtaatgggatggctgggtcaaatggtatttctagttctagatccctgaggaatcgccacactgacttccacaatggttgaactagtttacattggttggttgaactagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatggtgagcattttttcgtgtgttttttggctgcataaatgtcttcttttgagaagtgtctgttcatatcctttgcccactttttgatggggttgtttgtttttttcttgtaaatttgtttgagttcattgtagattctggatattagccctttgtcagatgagtaggttgcgaaaattttctcccattttgtaggttacctgttcactctgatggtagtttcttttgctgtgcagaagctctttagtttaattagatcccatttgtcaattttgtcttttgttgccattgcttttggtgttttagacatgaagtccttgcccatgcctatgtcctgaatggtaatgcctaggttttcttctagggtttttatggttttaggtctaacatataagtctttaatccatcttgaattaacttttgtataaggtgtaaggaagggatccagtttcagctttctgcatatggctagccagttttcccagcaccatttattaaatagggaatcctttccccattgcttgtttttgtccagtttgtcaaagatcagatagttgtagatatgcagcgttatttctgagggctctgttctgttccattgatctatatctctgttttggtaccagtaccatgctgttttggttactgtaggcttgtagtatagtttgaagtcaggtagtgtgatgcctccagctttgttcttttggcttaggattgacttggcaatgtgggctcttttttggttccatatgaactttaaagtagttttttccaattctgtgaagaaagtcattggtagcttgatggggatggcattgaatctataaattaccttgggcagtatggccattttcacgatattgattcttcctacccatgagcatggaacgttcttccatttgtttgtgtcctcttttatttcattgagcagtggtttgtagttctccttgaagaggtcctttatgtcccttgtaagttggattcctaggtattttattctctttgaagcaattgtgtatgggagttcactcatgatttggctctctgtttgtctgttattggtgtataagaatgcttgtgatttttgtacattgattttgtatcctgagactttgctgaagttacttatcagcttaaggagattttgggctgagatgatggggttttctaaatatacaatcatgtcatctgcaaacagggacaatttgacttcctcttttcctaattgaataccctttatttccttctcctgcctgattgccctggccagaacttcccaacactatgttgaataggagtggtgagagagggcatccctgtcttgtgccagttttcaaagggaatgcttccagtttttgcccattcagtatgatattggctgtgggtttgtcagagatagctcttattattttgagatacatcccatcaatacctaattttttgagagtttttaccatgaagcattgttgaattttgtcaaaggccttttctgcatctattgagataatcatgtggtttttgtctttggttctgtttatatgctggattacatttattgatttgcgtatattgaaccagccttgcatcccagggatgaagcccacttgatcacggtggataagctttttgatgtgctgctggattcagtttgccagtattttattgaggatttttgcatcaatgttcatcaaggatattggtgtaaaattctcttttttggttgtgtctctgccaggctttggtatcaggatgatgctggtctcataaaatgagttagggaggattccctctttttctattgattggaagagtttcagaaggaatggtaccagttcctccttgtacctctggtagaatttggctgtgaatccatctggtcctggactctttttggttggtaggctattgattattgccacaatttcagctcctgttattggtctattcagagattcaacttcttcctggtttagtcttgggagggtgtatgtgtccaggaatttatccatttcttctagattttctagtttatttgcggagaggtgtttgtagtattctctgatggtagtttgtatttctgtgggatcggtggtgatatcccctttatcattttttattgcatctatttgattcttctctcttttcttctttattagtcttgctagcggtctatcaatattgttgatctgttcaaaaaaccagctcctggattcattaattttttgaagggttttttgtgtctctatttccttcagttctgctctgattttagttatttcttgccttctgctagcttttgaatgtgtttgctcttgcttctctagttcttttaattgtgatgttagggtgtcaattttggatctttcctgctttctcttgtgggcatttagtgctataaatttccctctacacactgctttaaatgtgtcccagagattctggtatgttgtgtctttgttctcgttggtttcaaagaacatctttatttctgccttcatttagttatgtacccagtagtcattcaggagcaggttgttttgtttccatgtagtggagcagttttgagtgagtttcttaatcctgagttctagtttgattgcactgtggtctgagagacagtttgttataatttctgatcttttacatttgctgaggagtgctttacttccaactatgtggttaattttggaataggtgtggtgtggtgctgaaaaaaatgtatattctgttgatttggggtggagagttctgcagatgtctattcggtctgcttggtgcagagctgagttcaattcctgggtatccttattaactttctgtctcgttgatctgtctaatgttgacagtggggtgttaaagtctcccattattattgtgtgggagtctaagtctctttgtaggtcactcaggacttcctttatgaatctgggtgctcctgtattgggtgcatatatatttaggatagtgagctcttcttgttgaattgatccctttaccattatgtaatggccttctttgtctcttttgatctttgctggtttaaagtctgttttatcagagactaggattgcaacccctgcctttttttgttttccatttgcttggtagatcttcctccatccttttattttgagcctatgtgtgtctgtctctgcacgtgagatgggtctcctgaatacagcacactgatgggtcttgactctttatccaatttgccagtctgtgtcttttaattggagcatttagtccatttacatttaaagttaatattgttatgtgtgactttgatcctgtctttatgatgttagctgattattttgcttgttagttgatgcagttttttcctagcctcaatgtagaccataatttgtaattatatcttacatataaggagagagagaaaatgtgatcctttggaggcaagacatttgtaattcaacagggaaaagagtaagaatgccgaactaggtaggaaaaggaagagaaggatgcatatctagaatacaaagccacaactctgattgggtgatattcaggatcaataatgattggcatggttcagccatcagttaagcagggtgggtgctggctcttccacctccctagtgtgtcccactaattgccagccctgacttcacatgacagagaagggctagaattggccccatgccttagaaagagcaccggaaaagaggcagaaaaattgtattttagtttcactctaccaacaactggtcatgggacttcagacaaaccccttggcttctcccagcctgtttccacctggggattactacatttgtttctcttgctgtaacattttgaagaccaggtgggattccatgtgtgcgagtgttctgcaagctgtaagggacagtgctctgttctgtcaaagtagaattcaaacttatcctagggtgtgggcagagaggggagtgagagatagtttgctctttccaagtatgaaaacccttaaatgtatctattctaaaattggaaaaaagaaaagaaacattgcatgggaaattaaaacattgtataggagagcactcctgggaaacattgaacaggaacattttgatcagtgttttcgtaatgttataaccggtttaattaaattttctcaggactcaaggttttatcatgagaactttctccatgccaacatttgatgatcatctttctttaatgtatgaacatttaagtaatgcatatttgcacctagtataagacagtaaaagctcctttgaagtttgaggggcttgtggtgtgccatttcaccactgtgggtctacatttgtcctcatggactgtggcggaatgtatggtgaacaaggacaggcctcaggacatacttggaagtaattattattgcttttatttttattttttattttctattttattttattttgagacagagtcttgctctgtttccccaggctggagcgcaatggcactgtcttgcctcactgcaacctctgcttccctggttcaagtgattctcctgcctcagcctcccaagtagctgggattacaggcacctgccaccacgcctggctaagttttgtatttgtagtagagatggggtttgccatgttgatcaggctggtctctagctcctgtccacagttgacccacccaccttggcctcccaaaatgatgggattataggcatgagatactgtgcctggccatattgtttttcttttcttttctttttttttttttttttgagacaaagtctcactctgttgcccaggctggagtgcagtggtgtaattatggctcactacagcctcaagttccctgggctcaggtgtttctcccaccttagcctccctgagtaggtgggactacaagtgtgcacatgtgtggctaatttttgtatttttgtaaatatagggttttgctatgttgcccaggctgttcttgaactcctagcctcaagtgatctgccctcctcagcctcccaaagtgctgggattacagatgtgagccactgcgcctggtctattctggcctattttcttcttcttcttcttttcttcttcttctccttgtccttcttctcctgctccctctccttctcctcctcctcctcctccttcttcctcttcttcttcctcttctttatcctcttcctgttcttcttcattttgcaaattttattttattttttgagacggagtctcactctttcacccaggctggagtacagtgggctgatctgagctcactgcaacctccacctcccaggttcaagcgattctcctgcctcagcttcccgagtagctgggattacaggggtgcgccaccatgcccagctaattttttttttttaacatttcttcagtcttctaaaagtagagtgagcttcaaatcagttgagttgtatttcttcaagattttatagtaatataaacattatatatgtgtatatatgtctattatatgtctattaactgccagccctggcttcacatgacagagaagggctagaattggccccatgccttagaaagagcaccagaaaagggcagaaaaattgtattttagtttcactctaccaacaactggtcatgggacttcagacaaaccccttggcttctcccagcctgtttctgcctggggattactacatttgtttctcttgctataacattttgaagaccaggtgggattccatgtgtgcatacatacacatgcatatatacacatatatgtgtgtatatgtctatgtacacatatatgattttaatatatgcatagatatattttgctctttttgatttttttctctgaatatgagaaatattgtacggaaaaatatttttttaaactttattaatttttttaaatatatttttttgtagagacatggtctcattatgttgcccaggctggtctagaactcctgaccacagcaatcctcttccctgagcctcctaaagtgatgggattacaagtgtgagccactgtgactagcctatggaacaatcttgatcagtatttctgcaatgttgtatagagcaatctacagatcaatatctatacaattttatttatagtgatatatacaatgaaagatacatatatgtatctttcagttcagtgttctctggaaccatataaccatgtgtaccagtggtttgacaagttaggggtttctttgtcttgagttataagccagctggggtgggcagtcaggggctggtacagccttgagtgctgccaggtccctgggctcttcctcctgggctgttcttagtgacaactgctgtgtctcagttatcactcacctgttcccacagaagaagggaaaagtggaggaggcagtacctgtttcctctagaggatgtcctattggccaaacggagtcacctggcctattccagttaacgtgattttgagaaggcagattttagattttccaggctatatgggagaggaagacaggtgagaggagggtggagtgagtgctgaatgactcccgtcatatcgaccacaccagtcatgttcacacggttgccctagtacgcagaaaatacagaactgttttgttttgttttgtttttgagatggagtcttgctctgccacccaggctggagttcagtagtgcaatcttggctcactgcaacctccacctcccgggttcaagcgattctcctgtctcagtctccctgagtatctgggactacaagtgcctgccaccatgcctggcaaatttttgtatttttagtagagatggggtttctccatgttggccaggctggtctcaaacacctgacctcaggtgatctgcccacctcggcctcccaaaatgctaggattataggcgtgagccactgcgcctggcccagaactgtttttttctgaccagtattagcaactattctaagcactctgtagcattagtttttctgattctttttgttgggattttaaagaggctcagtaaatagcacctctttccccaccttgagttctgagttaattgagaaatatgacaaagggagcacatggaggccaaaatatcacttttaaaaaccgatagaagtgaggttgcagaatgtagctcatatctttgtgcaagtggactttctaataaaagcagaaataaataggcttggccatctagccatgggcaatgctggacccaagcagtgtgcctgcctggggtctcccatgtggagtagggggtggcggtggtgtctcggtggtacttatgccaggaatgagcaggactaaagtttcactccctgcgtgcatacttactcccaagaggcaaaaaagaggagctgtgctgagcatgcccggtttattccaaattcatcagtcacattaatccccttcttccttcctgaggaggagcagtggcggcagagagaaggtaagaaaggagacattgagagtgggaatacacattgcctcctaagacttgtaacccattttaaaatgctgctttaattttgcttgtcttgtttacaatgtgtttacctctgtaaaccacaaaaaatcctttttggaagtagtgtctgtgcaaatcatgaataaataaaaaataatctccactgaaaactaacatgaggctgaatgatgattgagggatttgaggggttgattccaggacacacagatcacattgaatgatgtggcgccatgagtggaagaccacagagcatcagcttcttgttaggatgctcatgagttttgtgtgtgtttgagacagttaatttgtgccacagatatgtcttctgtacaacagtaatgattgaattttgatcagctgtgtggtggtcatttttggcctctaagacaaattcatctaccaggctgggaaacaaacccattttgggtctaactgcaaaacaaagggttttagtgcctcactgtggaaaagacagtgggtgcatattgatttattcagcccacccacaaataacagagatcagcctttttagtagcatttatggtagagttttcaaatagggttttattgatctctcctctcacattgctgtgaattctgttatctatgtggtctgaaacagtccttctgaaacctgaatgtgtgtgagactctcaggggatcttgtcaagatgcagattctgtttctataaacctggctttgaactgaaagtttgtgtttctaatatgctcccaggggagtccattgctgctaatccaagggccacattttgagcagcaaggatcgaaagaccagagatatttggcccttttcagtggcaagaagtctctctctctgggtttggggttggagccactgttggtaaaatcaggggctaattgcagttctacttcatcaggaaaaatatcttactgcatttgtgaaagtagatgtcagttttgggtatttcataaactgtggctacttcttagaatttcacagttgggtgatatgatcactaataagttcagtgagagaaatgatgtgagatgaatggtatccattttgatattcaccaaaagaagtgccactttctattttctcctgactcagaaggctctgtgcagttgagtttctcccttttggtagaactcttgatatcggaggtgagtctgcaagccatgtaaccccaggtgagctcaccttctaaggccccttggtggggaaaaagcaatcaaatccacacatttggctctgcttttttctttaaagacaatctagaaatgttagcagtgaattgggagtttggtgacagacaaatgtaagatctatattgaaaatcgttttggagaataaggatcagaagtttttccattgcaaagacttgatcatacggagaagggggcatactggcctggttggctgaggttctctccaggggtactattcaagccaagatgtttcctagagatcatctcatttaacctcatttgtgaaaatgataatttggcaggcaaggaagcccagattccaaaggatgaaaggatttgggcaagagaaaacagtatgatagttccttaaaaaattaaaaatagagttatcatatgatccaacaatcccaattctggtatagatccaaaataattgaaagcagagtcttgaagaaatatttacactccagtgttcatagcagcatattcacaatagccaagaggcggaagcaagccaagtgttcatcagcagaaggataatcaatatgtgatatctatatatctatataatattattcagccttaaaaaggaaggaaagtctgacacacaacatgaattagccttgaggatattatgctaagtgaaaataagctagtggcaaaaagacaaatactatatagttccacttatatgagagtcaaattcatagaaacaaaaagtagaatagttgttgccaggggccaagggaaggggaaaattgggagggggttgttctttaatggatttagagctctattaatactttagcaaaagttctgagagatctgttgcacgatgatgtgaatatacttaacaccactgtatacatttacacatgattaagatgatttaaaaaattaagagatctgtccaggttatacagtcaaattgccttgagtctgaatggatatatggactataaatccatctgaattaaaaaaataattatgatacaaatggaaattctaaaaagttcaagtccttgaatggtaaagtcacttctcccagcctatgcagcattctagcacatgttaaataatgtgagtctgtacttcagttatgagaattgttttctcaggtgtgtgggaatttcaagtcatttcttttgggcataattttaaaaagaagaaatagggacttgggaagagaaaaataaagggaaagtggattttagagtaggcacgttaagattaaagccttcagggagagaaatgaaggtgaagaaacatacctgtggatttgagttgttctactgtgtgtttctggggaaagagattggaatacttggaggtagagactatgggttcatgtcaatgtgttctgctgtgttgggtgctcctgcagtagccagtgcttgcaccctgtttcctgtgttttcagtttccttttgctggagaaaaagagatgggggtcccacagctgcccgatccccctcttcaactaccattggcaattttacaatactcaggtggtgcaggttcttcacttcagttcctgtggaaaactttgtaagtttcaaatcattctaaaacagtggttttcaatcagggatgattttggctctctggagacatttggcaatgtctagagtaatttttattgtcacaacttggagagggtctgaggtatttcatcgtgtttaggacagggatgttgctaaacatcctacgatgtccagaagagcccccagtatccaataattatccaataaagcattgccaatagtgatgctctaaactctttttcatcttaaactttcaagttactcaatatcttgagttccttatatcttggaactagaagtcaaaaatctctagatcatagaatcagagaagtattgaatatatggatggaggagacttaggaaaaagatctttgtaagtaaggaagtcttctaacaagcaagggataggaagtagaaattaactgtgtgttactcattgctacattgttgctcagtagatactgtagtatctataatatactgtgctgttaatagtttagagaagttactatggtgtgctccagtggattatttttagtgggtgcaaaaatattagggctttcatggtttctttagttaatttagttcccatcagcttaaaaaatttaaccatgggaatttcctggaccatattattggaattgggaatactgtaatccttgaagagggaatgatgtaattttgtgtgtgtgtgtgtgtgtgtgtgtgtgtgtgtgtgtgtgtgttgatattttacctctcttttagttgtggtgcctttaggaaaagaaaacatcaagacaaggaattgtggaaaattagaaagcagttaatcagcattctaaagcagagctcatcaatgaagtaactggacatcaagaggagctgtaggatagatttaatgaggagttataagacctagagtttttcttaaaaacaaatgagagcttaactaaaataaacaaatggacaaaaaaacccaacaactgtgatatggtttcataggtggaggtctaacaaggactatttttacagaaaatatttttgagtgtttaaaatatgccaggcattgtactaaacactttatttaatttttaaaattgtaatttgataatttataacagcataaatttatgggtacaaagtgatgttatgatttatgaatacaatgcagactaattaactcaggctaatgaacatatctatcatttcaaatacttaacctttttatggtgaaaacctttgaaatttacttttaacaattgtgaaatgtaccacactctattaactatattcaccatactgtggaatagaaattaaaaacatttctcctccctgaaattttgtacccttttaatcatcatctccccacttcccccatcccgcaacctctgtaaccatcagtctactctctgcttctatgagtttgattgttttagatttcacaagtgaacatgatttcataagtgagaatatgtgatatttgtctttctgtgcctggcttatttcacttagcataatgttctctaacaccatccatgttgtcaaaaatgacagaatttccttcttttttttaaggtggaatagttttctatatccattcatttattgatggacacgggctaattccataacttggttattgtgaatagtgctgcagtgaacatgggaatgcaaatatctccttgacaaagtgatttcaaatctttggtaactcactttgggtattttggcaaacaccctgcagtgggattgctggatcatacggtaattctatttttagttctttgagaaccctccatacagctttccataatggctgtactaatttacattccattagcagtgtacaagttttcccctttctccacatcctcatcaaaacttgatgataatagctgttctgacaggtgtgagttgatctctcattgtggttttaatttgcatttccctaattctttgcaatattaagcattcttttcatgtctggtggtcatttgtatgtgttcttttgagaaatgtctattcaagtcccttgcctattttttaattgaattttttgttttcttgctattgaggtatttgaacttgtatattttgaatgtatggcttgcagatgttttcttgcgatctgtgggctgtctgtgcacactgttaattgtttcctttgctgtgcagaagctttttattttgatgtaatcccatttgtctacttttacttttgttgcctgcacttttggggtcatattcaaaacattattcctaagatcaatgtcatgtagtctttcctctatggcatttccaatgtcatgtttttttcttgtagtttgttacagtttcttgtctaaatattattttgttttatcctcagaacaactatgtagtagttatcctacttctcacattttatagatgaggaaattgaaattaaataatatgctgaaggtcatctaaaaagtgacaaaaccacaattcaggtcttcctccaaagccgaggatctaaccactggcgttacaaagaggggagggagaagtccataaacttctggtgtgactttggctgagttttttatattttaacaaaggagtaaggctagtggtttcttagattcctgtcgcctcttaagtgttctagtactttggttctgtgctttgttcagtccgacttgatgtggtctttttctgcaacttgagactcaggtctccagaggagtccttgagccattagaagcccatcccttgagcatgttctccacctcccggcggcttgagagatgtcgtaggacagctgtccctggggagttaggtagtccttttgctcctttttcccagcagctgtgtattacctgatggtaaattcagagtctacttcccctctagggaattatgactgctcgttaaactgtcaccctgcaaaaacgctaatccttgttccctaatataacttagaaagacaggggcaggttacccctgcttaaaaataaagagcatatttatgtaattaatattctcagcagaatgaaattatataatatgcaagtgtctgaaatggaatggtacagctcctggcattctagcatgtgggaattcttagcaataatactttaatgagtcttggttttgtcaggtgttttcctaattttttcactttaaattcttacaaaggtcatagaagttttaagatacttttttttttataaagagaactgagaaatttaagtgagtaagactgcatagagtaagtccctgatcttagacttcctggctgtaaatcaatttctgatcaatgtgtaatgacggaccaacaatcctcatttgcagaatgtctttacatttttttgggaaagatatttgctagtattttgtctagaaatttgcttatgtctctggtgttttatttcagctggaaagggaatgtgtcctgatttgaacttcattttaatggctttcccttagatggaggacagcagcaacttttaacaagatgaaaaatcttcgtagagaaatctgaaaaattacctatgagaaagacttccttaaagatatacataaatctaacaaaatggttccaaaagttggttttgctgctaagatgtctccagttattttgttattgttaaactctcaaaagaaattagtttgaatttcttcacttaggattggtggaaggcagtggtagtgaatgcaagtcatgaagagcgatgggtagtgttactctaaattgctggcttcagttttttggttgtgcaaagttctcctctgtacacactttctttccttttaggttctagagccattgttgtcagggagaggtctgcagggccctcacgtggattctggtggggcacttatttatttacttatatgagactcatactatactttggaaattattaatttaggacataaaccttgcagatcatccagttttgtagaaatggtaaattatacatagatgactaatgtgcaatttgacacaaactagtccacaattactgacatgactttgaccagatcacgtaatctttcaggacctcagttccttttctgtaaaatgtttgacccatgtctgctcagatggtttctaatctaagctgtgatttttttgaaagcttgcttagggttaggaagagtgggagaggggagttgctataccgtatatactgtatttctgaaactaacgttaagaagttgctcctgatccccaagggctttaaaatctagttttagggtttctttaacaccatttattctggataatttaaggttatctgtgagcttcgtgacctccagcaagttactcgacaactctgggtttcagtttttgcatttgtaaattgatggactcgaatgagaggggttgcaaagggtcttctcaaaactatactctggtttcttctaaacctactgtggcctagatccagatgctagcatactcgaagtagttgtttgttaagagagtggcccctggggtccagctgcctcggtttgaattcccactttgtcctggccagtggtgcaaactggggcagcttctgtggcctctctgtgcccagtcctgcctctgttaatgcagggatcatgtgggccaatgcccaggatgcacttaaaacacagcctggcctggcacatggttaaacactaaaaaatgtgggctgtcattacttttaaaatttaattccgttcaggaagagagtggtgttagctttcattttagcgggcagggtacagctcttcttgtggcttttctgagcgggttgcctgcctcacacagtaagcttgctcagcccgtccatgttgacgactcttgcttgggtgctgtgtatttggttgaccctgagccaagaggcataagaaatgtgggcttcattacaccagagtgttcttggctgggctgagcctctccattaggcatccaccccattccccatagcgatgaatggaatctctgcttccttgtgtctggagagtctgttgagagctcccctacgaagcaaagagtgacacgggagaaagaagacgaagctttcaggttataaatagcttcctcacaagatgctcttgctatgggcttctggtaattacgacaggcgctgttggttataatcaagtttaattgctgaggagcgtagggaggtagccccaaacacgtaagctcacgggctatctttatgctttctctatccagttctggaccttaaaatctctgattatgtctccaaccagcaagatctggttgtgtatgggagtaactccagagccctttgtggttcctggagtgggtctggaactttcatggatagtctgcctgctgagacgttggctcatgcactttactgcatgtgggaaggtgggatggattgaataaaggagcagagagccaatgccctggaaatgcagatatgggcctttttgcctaacttctctcatagaggcacagtctgtgttcgtgggtgtgcatgtgaatgtctgtgtactgtgtttggggatgtagaccgaaacaaaaaaccagcagaagacatggccacaaagcattttcaggggttgtttcatagtgtcttccagaaatgtgacccaatcttgctgcagctgagcaggaaattttagatttcttttaattcttgtttatccaaggtcaaattatactttgtaaattattattaaagtctcttgttcttccttctctaactgcagtgagtttattgtctattgatgctccattcagagtttgtatgggcaaagaaaggaaattaagacctcattaattgatttttctacttaattacttttataaaatattttgcctgaaaagttgaaagtgatgtctgaaataaagtttggattcctgaaattggccaacatcactcacgccatgatatcacatacttgctgagtggtcagtgtttgttagaatttggctttcttctgtctttactgtgggagctggaacggcactcctccagcttcctttctgtccacttttaggcctcaggctatgataatagctttaaagtggctaagaagacctctgtaggctccgcttcttaccctcactcctccaccatcttgctttgccctgctgcttatgcccactgcctgggacctggcttccttctcccagcccagtccctgcagatgctagtgcactatttccttggatcttagctgcgacttttgcaggatgctgtggtttgatctccattggctctaccctccagcatggccagttccactaaatgcggtgcctcctcaagctctcagaacccccacctgggcctggggcactggaacctttttgtcctggcatggaaatcagatgtttaagccatgcactggtgctttgctgtacacagctataattctcagtgggggttatcttgcctctgtagctggagaactcactgggttaggcatagtccagtgttagtgagacttgtgatcatgaccatgagttatgtgtgagtcattcaccattgttgtgctccatattcccctgctctcgtcttgtcttgtcagcttgcaaatgatgctaccgatctccaggaggcaggtaatagagcaatgctcacccatcctagcaaagaacaaaacacaaccaaagcaaaaaaagtactccttccttttcccctcctcacaaaacacacacacacacacacacaccacactccttagatcggtagctgtatttccatacatgaaagatagcataataataataatcataatcataataataataaagttggcataataatgatgatatggtaattataataatcatcttgtaagtagccttggggagtcagggtgcttaaatgttctaaccaagctgcttttaaatgactcaaaggattctaaatcttttcaaattttcttttggaaaatttgactatattctaatgacttacttgtccttctttctttttaaaatttaggtgccatacaaaacatttgcacatttcattggcaattgtatttaagttaaaaaagaaatatttgttttcctcttcagtgatgatatcttttcagatacttaaaagataaattgtcactctatctgagttactaggctaaaaatacatgttgattattgtgcatttttattaatctgttgatttcagattatgctggttcaattttgaacctttaagcttgtcttgctttaagaaaaactgatagataaaaatgaaaacttaaaatacatacttttttgggggaggaaaggtaaactttttacattgtaacaaagtcttttgctttattatgaattcttttatttatttatttattttgagacagagttgctctcttgtccaggctggagtgcaatggtgctatctcagcttactgcaacctcttcctcctaggttcaagtgattctcctgcctcagcctcccgagtagctgggattatgggcgcccaccaccatgcctggctaattttgtatttttagtagagacgggatttcatcatgttggtcaggctggtctcaaactcctgacctcaggtgatccacctgcctcggcctcccaaagtgctgggattacaggcatgagccaccacgcctgggtcctttagttatgattatcaaaatttagacttggtatgtagctttcaggagaatatttatccattaaaatctcacacatcatggcgattctttaaagacttaaagacagaaataccatttgacccggcaatctcattactgggtataaactcaaaagaatatgaattgttctattataaagacaaatgcacttgttcgttcattgcagcactattcacaatagcaaagatgtggaatcaacttaaatgtccatcaatgatagactggataaagaaaatgtggtacatacacaccatggaatactatgcagccataaaaaagaacaaaatcatgtcctttgcaggaacgtggatggagctggaggccattatccttagcaaactaacacaggattagaaaaccaattagcacatgttctcacttataagtgggagctaaacaatgagaacacatggacatagtaacaacacacactggggccttttggagggtgaagtgtgggaggagggagaagatcaggaaaaacaaccaatggatactaggcttaatacctgggtgatgaaataatctgtacaacaaacttccatgacacaagtttacctgtgtaacaaacctgcacatgtactcctgaacctaaaataaaagtaaaaaaaaaaaaaagctttcattacaaaaaaaaagaaacctcgcacatctattcacaatagccaagacatggaaacaactaagtgttcatcaatggatgaatggattttaaaatgtgggacagtgtataaatacacaatgaaatgctatgcagccttaaaaaccaggaaattctgagctgggcgcggtggctcaagcctgtaatcccagcactttgggaggctgaggcaggcggatcaccaggtcaggagatcgagaccatcctggctaacatggtgaaaccccgtctctactaaaaatacaaaaaattacctgggcgtggtggcgagtgcctgtagtcccagctactcgggaggctgaggcaggagaatggcatgaacccgggaggcagagtttgcagtgagccgagatcgcaccactgctccagcctgggcgacagaccgagacttcgtctcaaaaaacaaacaaacaaacaaacaaaaaacaggaaattctgtcatttgcgacaacacggatgaacctagaggacgttacattaagtgaaataagccaggtaaagagaaacacatactacatgagctcacttaaatatggaatctaaaaaagtcaaactcatagcagtagagaatagagtgtggtttcagaggctgtgcgggagagggccagaagtggatggggaaaagggaggcgctggttaacggatacaaaacttcgattaaacagaaggaataagttttggtgtctgattgcacagctcgatgactgtagttaataataatgtattgtatatctgaaaataacaaaaagaaaggattttaaatgtcttaccacaaagaaatgataaatatttgaggcaataggtatgcgaattatccttacttaatcattccacaatgtgtacatccattgaaacatcacattgtacccatacatgtatacaattattatgtcaattaaaaataaaataaaatgtaaaaaaccccctcacacatgtatattctaattccagatgtttatttctcactgatcacagatgtggccagtaaatggttctctctgtgttttgagtttccgttgccctgtagtacagtttgaaattgggtaatatgatgcctccagctttattctttttgcttaggattgccttggctaatcgagctcttttttggttccatatgaattttaaagtggttttttctggttctgtgaagaatgtcattggtagtttgataggaatagcattgaatctgtaaattgcttgggcagtattagccaagattttctaattaacttctgttttcccactctacatcatgtttattgtttctttgttaaatgcatagaatgtgttcaaggtttgtccagaagctcccgaggtcttatgcttctgagttgcacaattgtctgccatgcaaataaatataagaccttgagacataggcaccagctcttcagtgagtttgatattaataaactggagccaaggtttgatattctgtaaagggaggtgggtgagacagtgggaagggagtggaggtggatctggaagcctgagcctggatgttaggcttgctcctgcacgtgttcctctgcggtcttgagccactcagctgttctggttcatcttgttaatttaggcataataacttctactccacctatgttatacacgtggagataagatgtaacaagatcaatggctacagtgtactttcattcagcaaagatgatatacacatgctctgtgttaaatgccgggtcctagcaggaagcaggactgccttgttggaacttagactcttatgtgaagacaaacaataaacaagtaaacaataaggaattacaaaccaaggcaagtgctataaatcaaggaaactatatattgcatttggggaggggtgcttaaataggaagatcattaagaggaattgatgtgtaagccaaggcttaaaggatgcttgagaactgtaatgtgtaatgtgtaatgttagttcacgattctgatatcaaaaaccctagagtggaagtttacacatgtgtgaacatcataatcatctcaggcacatccttcaaattgcagattcatggaccttcctctggcgggggttgggggagtctaatttagtagtactgtggtcaggctctagaatctagaatctgcattttttaaaagcatccagatgatcctgttgatctgttaagtttggaaactattgtcttggagaaatcctagtgagaaacaagagtttcctttcaaaggaatgactatggcttagtcttccttaattatgcttctcatctgccacgctttgcttcttacaccaccttcacgatttggaaacttctgtgatctaggaccctgagcctccccaacgctgctatgggacttgttccctttttcccagcaggtgtattatatgaagagaaacttccagacgctgttaagtgggagaaggggctgtatttctagtgcatatattggaattctggtgtataccattgtatgttgagttgactgctgtggcctggtttggcaatctaagtctttttgtaattttatacccgcaggaaaaatgtttggaattccataaaagtaggcatgaagaattctcccaccataattcattgtatctttgccctctgcctagttttaatataactttaatatgctttgtgtacatatttaatatatttaatgtaattgagtggtttcaaattgagtggtttcttgagtggaactagaagtagctcttatcttgggatcataggttctaccgaagcctatttgagtcttggggaaaaggaaccgaagctgcttcctctcttctctctccctcctgggggatttcaggggattcagtagcaatttatttgagaacattagagtggccattgggatttccctgtgagagtttttggtttgttttagaaatcctcctttgctccaagctatgttttaaaaatgtccagtaggctagtggctggcagggtgtggctcgtgtcaaacaatcttttggaacacagcctgtcaccttctgcttcaatggagaatggcctgaatagtgattcttagttatcttggatgtgcactccattgctttttatgctcaatcattgctgcctgtaggaccaccccaacctgaatgatgactgtcattctctgataagaggaaggagttaacacctggtttgtgaacatatttatcttaataaatcacagggagttgttagagctcacccttttctttcatccaggagaatccagaagtgtcaaggtttctctggcaggagcccggcctgcaggttgggtgagaaactcacgaataggactctgacatgtgtgttcaactctcccttggaatgtctcacttttatttcagcacaattcccatgttcacctctgaggtgtaaggtggagtgggtagcctcctgcttggtgtgctaataaccaaaacagattaccaatcaccttccctttgttttccttggcatgctgaaaaaggcatacaaaaatactaatatgagcatcagagaaataaataaactcagaaaatacaagaagcagctgggcacggtggctcatgcctgtaatcccagcactttgggaggccaaggtgggcggatcacctgaggtcaggagtttgagaacagcctgggcaacatggtgaaaccccgcctctactaaaaatataaaaattagtcaggggtgtggtggcctgtgcctgtaatccaagctacttgggaggctgaggcaggagaattgcttgaactcggaaggtggaggttgcagtgagccgagattgtgccactgtactacagcctgggtgacagagtgagtgagactccttctaaaaacaaaaaaacaaaaacaataaaaaagaaatacaaaaagcttagaacttgggtaatttttaaggtatagattttagattttagcaaaaatgtcttgcttctaggactggttttatcttatgccctttcttgagaattctaatgtctagtctcagaggacagtgaaaaactcacatatatctagtcagacttaacttttgcatggtctctcgcttgctcccacaaggaaggcaactctttcctaacctgcttttcctatagttagaattcttatttttcaagattttttcttggctgctgtttcagatttcttcctctcctttccctctccccagtggtgaggtgaggaagggggtgtggaactcaaactttattttattttttagagacagagtcttgctctgtcacccaggctgcagtgctgtggcatgatcatagctcactgcagcctcaaactctggggctcaagcgaccctctggcttcagtgtaatttttcagttttgtggagacagaatcttgctatgttgcccaggtggtcttgaactcctggcctaagcagtttttccaccatggcctcccaaagtgttgggattacatgtgtgaggcaccacacccagccatacactttagtgagtttcagaatcacataaagggcttgttcaaacccagattgctgggctccacccctaagaaggtagaggggagctgagaatttgcatttctaaaaagggtccagtgacgctatgctaatatccctggtttggtaacaaggctccgtgtttttttgtttttttttgagacagagtgcagtggcgtgatctcagctcacaagcgattctcctgccttagcctctcgagtagctgggattacaggaacccggcaccatgccgggctaatttttgttttttgagacagagtctcagtctgtcacccaggctagatggtagtggcgcagtcttggctcacggcaacctctgcctcccaggttcaagtgattctcctgcctcagcctcctgagtagttgggattgcaagtgtatgccaccatgcccagaaaattttttgtatttttagtagagatggggtttcaccatgttggccaggctggtcttgaactctcaacctcagatgatccacccgccttggcctcccaaagtgctgggattacaggtgtgagctactgcgcctggccaattttttgtgtttttagtagagacgggatttcaccatgtctcccaggctgatctgggattacagctttgagacactgcgcccagccaataatactgtatgttctatagaacatgatgttcacagacttcattcattggttcattaattaattcattcaacaaatatttactcattcctgctgttctcagacagtgctgtgggtgctagaggttatgctgatgcacaagatgaagttctcgcctctgggagcctctgtgctggtgcaagaggcagacatatatcatgtaatgtttgtctggtataagggctatgaagaaaaagcaaataaagtaggtctctttgtaggagagtggtggctagggaggatttctttgaggagatgaggcctccaggcagaggagtggcaggggtaaaggcctgaggtaggaaaatgtttggtgtgttggagcctcagcaggaagaggctggtcttactgggagttgagggagggagagtggtcagagcaggcggcacaatgttggtaagagtcacacacacaaatattcctgtgaccagatacgttcaggaaatattcgtttcaacaacactaaaactttttttttttttttttagtgtttttttgaaatagggtcttgctctgttgctcaggctacagagcaagcttaagtgcaatcccagctcactgcagccttgacttccggggttcaagcgatcctcccacctccgcctcccgagtagctgggactgcaggcatgcgccaccacgcctggctaattcggttcattatttttgtagagatgaggtctcactatgttgcccagactggtcttgaactcctggactcaagcgatcctcccacctcggcctcccaaagtgctgggattacaggtatgagccactgtgcccagcccacattaaacgtttttctttattgaagaattttctaagcccttttatcgtgctgatccccattattaatctccaggagagagataaggtatttttttctcaaatttacgtgaccatgaaaattttactcccacaatcacctcgtagactgatgttctttgaaatgcatttgggaaatctcaatctagcaagtcctactctctcattctctaactgggaaaactgaggagcagagaaataaaataggctgttccaaataataaagcttgaggcgacatgaggtggtggaaggaacacagagtttggaggtggaagatgacgtttgagactttgctcttgcattttgtgaatgtgggacctggcctctgttgcctgaactcagcgggtcttagtttgctcagccaaaatgagagattgcactgtttgctctctgaggatcctggagtcactctgggtgagtgactactgatttttttgaccagggagccttgtgtcagctaagccaaaggaaagcactgggagatgcacataaatacattcatcaaataccatcatctaggttatttttgcattcaaatgaatatacttcccaggcaagtaattaaaataaaatctgtcagagaatgtaaaactctaaatcataaaatgttcgttaaaaaaaaagaagcaatggagaaagactaagatctatagtaatgtactttgctgtaaaatattttagcattgatttccatttttatgaaattcatagttgatttgaatacaaacagtaagtctcatcacaggtgaaacctatctttttcttgtttgctttccgaggaattgttgaggaaataattaggaaaaaaaagactcttggattttagttttttactagctgtaaaagctactttgagttgatgtttctttatctataggagggatccaaatattccttaaggtctttacagctctactaatttaagatatctgtatttgacaatttttgccttgaagagatgttagcaatagaatcttggtcaaggtgtggctgggacctgagggttctgaggacttaggatgtgagctgtgtacaggtaaggtaaagtcatggtaaataattatgttaaagagaagatgccagttgggagctctttggtgagattttcctaaggaattctgctgttcctgcagagcagcaaagtttgggattgtttaaagaaagaatgagggtgtgtaagttccattattatctgttcacaagtgtgggttctcctcattctgggcccagggtaggaatgtactttctggcacctttggcgttggatggggccatgtgaccaattgtggccaaacagtcccatgtagttctgcaaggtatatatccaggctggaacacttaactgccaggggaacacccttttcctctgtcaaaggggtggcaacgttctggtgccatcagcctgggttctggaatcagaagtcatggagcagatatcccagatgactcttgaatggattatgaattgtgaccgaggaataaaccttcgtgattataaaccctaagatatttaagactgcttgttactgcagtgtaatgtagcctgtgctgactactggattcaataagttgagaaatcccaatgaatcaaagggagaacagctatctggtaaataattatgtaaaagaaaagatgccagttggtatccctttggtgagattttcctaggaattctgctgttcatatagagtagcaaagtttagagacttggctaaagaatgaatgaatgaatgtgttccattgttatctgttcaaactggtataagctataaagcacatcatgcaagaggcagtatgctagtttgggcaggcctcttctcctcctcctcctcctgggaggtcaaagctgcagtgatttgtgattgtgctactgcattccaggctgagtgacagggcaagaccttgtctcaaaaaaaaaaaaaaaaaaaaaaaaaattcaagcgtctgtgaattttcaaaatgtaaaataccaaggcttttccgaatcagataaatcaggaatgttcacctttacatccaaaaaagaaaaatgacaaaaagttcaagtagaagttcagcagaataatgtaaaatctgaaataggtgaccaaaatttcaaattatcaacagatagttcaatttggtggatctttcagtaaactttagtttgaaacaacagcaaaaaataccatttaccaaaacatgaaaaatattttcaggaaattattatctaatttgaaaaataaaaaatgaaatccatagtaaataagaaaaatacaaaaaagaaaatcaacctttgatatggtttggctgtgtccccacccaaatctcatcttaaattgtagttcccctaatccccacatgttgtgggacagacccagtgggaggcagttgatcattggttatcctcatgctgttcttgtgatagtgagttctcacaagatctgatggttttataaggggcttttcccccttttgctcagtacctctcttcgctattgccatgtgaagaaggacgtttttgcttccccttctgccatgattgtaagtttcttgagacctcccctgccatgttgaactgtgagttaattaaacctttttcctttataaattactcagtctcaggtaagtccttacaacagtgggagaatggacaaatacaacctttataggaatcaagagaatattatggacaaataaaaacttcctagatcaatagcatatcgtgcattactgtgtgtagaaaactgtaattaatataaggtagtttttgttagttgcatattctaaaagcatgaaaaaaaattgattatatctctaacaagaccacagagttgtcattgaaatacacatttcttgagacaatgggcaaagttcccatttgtgggatatttctttttatttgtgggaaatatcttcttcttttcatacagtgaaacaaagaaaaattgtaccagatgagaattctttttctctaaagtaagcttcttaaatacctccaataacgtaatacttgtaaaatataaattttcaaaactcagacttgaaacaggttattattaaacaaacacacacaaatctcattgcttggcaccagatttttcaaaagttaaagaattatttaaaccaccaaattgtgcttaaatcatatttcaaacttttatacttagtgcttttatgttctgaatgtagactctcaatctaatgacagtctagtctgagccctgcaatatatagacaagcaagtaacatttcacttcaaaccaaaagaaaagattaatcttctattgttgtcaaaatcataacattaagataactataaaagttaggatttatccatggccaatgtatagcattctatggaaagcctttctttaatccttctttactttcagcttcctctttggaaacttcttcatccacctcgtgttcctcctccacattgttcaaaggttgagaagattctggtaataattttttggactggtgctatggcttggatctgtgtccctgcccaaatctcatgtcgaattgtaatccccagtgttggaggtggagcttggtgggaggtgattaaatcatgggggtggtcactcatgaatggtttaacaccatccactctgtggtgttcttgtgatagtgagtgggtgagttatcatgagatctggttatttaaaagtgtgtagcacctcttccctctctctcttcctcttgcattggccatgtgaagtgccagcttcccctttgcctttcactgtaattgtaactttcctgaggcctcatcagcagccaaacagaagccttcatacttcctctacaggctgtagaaccatgagccaattaaagctcttttctttataaattacccagtctcaggtatttctttagagcagtgcaagaaaggaccaatacagaaaattggtactgaggagtggggcattgccatacagatacctgaaaatgtggaagtgactttagagctgggtaataggtagaggttgaaagagtgtggagggctcagaataagacaggtattgggagaaattcagccagatatcaggtgaaattcacccccgatatttcatgtaggttcttttctattttccctaagtgtcggctggtctgagaagtaaagggaaagagtacaaacgagaaattttaaagctgggtgtccgggggagacatcacatgtcggcaggttccgtgattccccctgagccataaaaccagcaggtttctattagtggttttcaaaaggggagggagtgtacaaatagggtgtgggtcacagagatcacatgcttcacaaggtaataagatatcacaaggcaaatggaggcagggcgagatcacaggaccacaggaccggggcaaaattaaaattgctaatgaagttttgggcacgcattgtcattgataacatcttatcaggagacagggtttgagagcagacaaccagtctgaccaaaatttattaggtgggaatttccttgtcctaataagcctgggagtgctacgggagactgggacttatttcatccctacagcttcgaccataaaagacggccaccccccgccacgaagtggccattttagaggcctgccctcagggacgtattctctttctcagggatgttccttgctgggaaaaagaattcagcaatatttctcccatttgcttttgaaagaagagatatatggctctgttccgcccagctcaccggcagtcagagtttaaggttatctctcttgttccctgaacattgctgatatccttttcttttttcaaggtgcccagatttcatattgttcaaacacacatgctctacaaacaatttgtgcagttaacgcaatcatcatagggtcctgaggtgacatacatcctcctcagcttacgaagatgacgggattaagagtttaaagtaaagacaggcataggaaatcacaagggtattgattggggaagtgataagtgtccatgaaatcttcacaatttatgttcagagattgcagtaaagacaggcataagaaattataaaagtattaatttggggaactaacaaatgtccatgaaatcttcacaatccatgttcttctgccatggcttcagccggtccctccatttgaggtcccttacttcccgcaacacaggaagatgaaggaaagtttggaacttcctagagacttgttaaatggttgtgaccaaaatgctgatagtgatatgtacaataaagtcaaggctgctgaggtctcagatggagataaggaacttattagaaactagagtaaaggtcacttttgctatgcattagcaaaggtctggctgcattgtgcctctgctctaggaatctgtggaactttgaacttgagagagatgatttagggtatctagtggaagtcatttctaatcagcaaagtattcaagatatggcctggctgcttctaacattttatgctcatatgtatgagcaaagaaatgacctgaaagttgaaaaaaatatatatacatacacacgtatatatacatatataatatatatacatgtatatatgtgtgtgtgtatatatatatatataaaatgtttgagacagaatcttgctttgttccccaggttggagtgcagtggcatgatcatggctcactgtagacctctgcctgccaggctcaggtgatcctcccaccacagcctcctgagtagatgggtttataggcatatgccaccacgcctggctaattttcttgtatttttagtagaggcagggtcttgctgtgttgctcaggctggtcttgaactcctgttctcaagtgatcctcctgcctcagcctaccaaaatgctgtgattacaggtgtgagccactgcacctggccctggaatttatatttaaaaaggaagcagaacacaaaagtttggtaaatttccagcctggccatgaggtaggaaaaaaaaaaaaccaactctcattttctagggaggaattcagtcaggatggataaattttcatagttaaaagtaagacaaatactaatagataagacaatgggaagaaggccttgaaggcacttcagagaccttcatgacagctcctcccatcacaggcccagaggcctagaagggaagagtgatttcatgggccagacccagggccccccctgccctgtgcaatcttgggacactgctttccacatcccggctgctccaacttcagccatgcctcaaagagtcccaggtacagtttgggccgatgcttcagagggtgtaagctgtaagccttggaggcttccatgcagtgttaaccctgttggtgcacagagcacaagagctgaggcttgggagcctccacctagatttcagaggatgtttggtaaagcctgaatgtccaggtagaagcctgctgcagggtcggagccctcatggagaccatttactagggcagtgcagaggagaaatgtggggttggagcccccacacaaagtccccattggggcactgcctagtggagctgtgagaagagggccaccatcctccagaccccagaatagtggatccactgtcatcttgcacccttagcctggaaaagccacagccactcaatgccataccatgagagcagctttgaggactgaatcctttaaagtcacagggcagagctgcccaaggccttgggagcccaccccttgcatcagagtgccttggatgtgggacttggagtcaaaggagattcttttggagcttatgatttaatgactgccttgctggattttggacttgttggacttgtaaggggtctgtagccccttttgctgaatttatctcttttggaatgggagtatttacccaattcttgtaccctattgtgtcttggaagtaactaacttgtttttgattttacaggttcataggctgaagggatttgccttgtctcagatgagactttgaactttggacttttgagttaatgctggaataagttaagactttggggggactgttggaaagggataattgtattttgcaatgtgagaaggatgtgagatttgagaagggccagaggtggagtgatatggcttggatttgtgtcctcgcccaaatctcatgtcaaattgtaatccccaatgttggaggtggggcctggtgggaagtaattggatcacaggggttgtccctcatgaatggtttagcaccatcccctcagtgctgttctcatgatagtgattgagtgagttattgtgagatttggtttttaaaagtgtgtagcacctcttccctctctctcttcctcctgctctggctatgtgaagaaccagcttctcctttgccttttgccacaatggtaagtttcttgaggcctaccctaaagctgagcagaagctgtcatgcttcctttagagcctgcagaatggtgagccacttaaacctcttctctttataaattacccagtctcagctatttctttagagcagtgcaagaatgaactaatataacaagtatggctgcagtctgcacctttttgaaggacaaaggcaatctgccacaaatatcataaagagtcctaaaaacagccctgaaagcagaattgctaaagcaaaaactgtatacaatttccaaaccggtaatctaaggtcttcaataaaatagttatgacaaatcctgatccacatagagagctgaaagagtgctgacatactgctcatcagaaaagaacctgaaccaaaccatgatggaattggttcaatactcttccacttttcatcacttataaagtttctgaagtccttcttagtccttggaccctgatggtgtctaaattcaccatctttacaatgataaatagtaggagagcagttatgatgaactgtctactcagtcctggctgccctgtgacatctacttttgctacattaacctcaagaacttctccccattcagcaaaactttcccattctggtggaagcttttgacaagcagggtaccacagggcacaaaattctatcatccagtctccttccagcaactgtcttcagttctcatccatggtaatgcatacatctccctgccacctgttctgtttctttccatgccctctaaagcaatagcaccaggactgccagggaaaccatgactcccagaaagtgccatgtctgctgcttgcccacctcacaagtgaggcagcctcagcagacttgatctctctgggccctggtttctccatctgcataaagggatagtaatattatctagctcatagagttgttgcaaagaataactgttaagatatgtcaagaccttagactaatgcttggaatgtaataggcagtcaataaatcttagccattcttctctctcctctactccctttccctctcatttttaaaaattttattttatttatttatttatttatttatttatttatttatttagagacagagtctcactctgtcacccaggctggagtgcagcagggcaatctcagctcactgcaacctctgtctcctgggttcaagtgattcttgtgcctcagcctcccaagtagctgggattatgggtgcgagccaccacacccggttaatttttgtatttttagtagagaggggttttgccatgttggccaggctggtctcaaactcctgacctcaagaggataggccaaggctgatccatctgcctcaaccttccaaagtgttgagataacaggcgtgagccaccatgtcagctctattattattattatttttattgacataggaaaaaaaagactcaaaggataaacatgtgtgaaagtagccatctctgggtagtagggttctgaatgacttttatttctttggattttttttttgataccaaatttgtgtgcactgaacttaagttactttatagttagaaaaaaaatattatttaaaaacagtttattggctgagcacaatggctcacgcctgtaatcccagcactttgggaggcccaggcaggtggatcacttgaggtcaggagtgtgagaccagcctggccagtatggtgaaaccccgtttctactaaaaacacacaaaaagtggctgggtgtggtggtgtgcacctgtagtcccagatacttgggaggctgaggcaggaaaatcgcttgaacccaggaggcggaggctgcagtgagctgagatcatgccactgcactccatccagcctgggcagagagtgagattccgtctcaaaacaaaaaacaaaaaacaaaaaaaccaaacaacaacaacaacaaaaacaaacaaacgaaaaaaaaccttaaaaaaaccccaaaacagtatatttactatgattttttttccaaagagtataccactcactacattaagtcctatgattagtgcttttacctccgttttatgacctatttccattagctttcatctactttgaaacgtcttgcatcttgactttaatttcattaatgatattttttccctaggccacctattgttgagaccagtgaatctcctggtctctaataacttatcaagtcttatgaatcttttctcctaaacctctcacactactgtccactgtcccagcctacttctgatccttaccacttcatgtctggactatcgagttttcttatccatcgggttccttttaattcttacatagtaaagccagacaaatgctcttaaaataccaccttatatcattcctttgctcaaacactggcataggctccttatattccccattgccgaggacaaaatccaatttcctggctcgacattgaaagctgtccacattactctatctctgctatttcaaataattcactccttaccttatttacggtcttttcctaccatatttctgtacaggagcacttttgccctcctgccccctttatgcccaaattttacttgtccttcaagatcttgccttaatatacacttgtctgaaatgttcattttttttttcctttgtgaattgcgatagcactgctctgtttggccattaatcacacactggcttgagattttcttatgttgaaatggtattaatctatatcttttaacatttctgttgtctgtttcttctctccaactaaattatagtatttctaagggtgcttacattttctaacaccccagtgctctacagaagaagatgggtaatagctaggatattggcagatggattaatatatctaatatttgataaaaatagatgctagaataaaaatacttcattttatttaaaagcaaagacagaattttgacttggatcttttccttgttgactttgttttgactttactatttataatgttgtttatcctgatagtctgagcttcttttaatggttagatcaatatttgcttgaatatcttccaaagcaagccttctgtaattcacttattagagaaggtctttaaattcttgggtataggattttaaaaatgaaataatgcttcagttagtaaaatcctagtttcagagcaaatgcttctgttgttaatgacctggatgctgtcacactggactctgggcttcttgagggaagttactatttctcagtcgtctccatgatctcagtgcctaacacagcctctggcacgtgtgtacttgctgtgtcaaatgaaaactgcggagcagcactgcagacttggaaggagagaaacattacatctcagatatttttaaatgtattaaatatttgtcatgaatttaatatttttcttctaaacaaacaaagcacaatttttaatgactgtaatttaacaatatagtgtccctccctcaaatctcttatctcctgactcagtacatccatgtcttggatttacagtgtctactcattttatcatgattgctgccattctggttttgcagaggtttcacgtttctctgtccctgcagagcgatcatgctgggatggctccgtgcatgttcttgcccccagtttctgctcctttgaaatgtaccctagaacacccaggtggtgggtggtgatgggagctcagctagccaagaatgagggaggaaggggatgtgatcagaggacctttaggctgcaggaacagagggacagttacaagaagcctcagctctgcaccctctgacagcctggggaaattccagccctttattcttttccctcatcccttccttcctttcttccctcctccctccattcctccctcctttccttctttctatgtaagtaacattggaagggaatatgctgtttgtacaatggcagtcctggcaacagctctctgttctcttcaaatcccctgaagtcatggtatgcctctggccttttttctttctggttctactcactcagttgttactcagtcttcctgggcagcagttgtgtttatgatgccctcagaatgtcagcagtctccctttaccaatcccatgtgactgctgatcttcaccttcactgtccttgattctttttgtttttagttcatactgctcttgttcattgtagtttaaaaccgcatattattctgatgtgtgcacgtatcacagtttctttcctcaattattattctttttttttattttagagatagggtctcattatattgcctaggttggaatgcagtggctattcacaggcacaagcatagctcactgcagcctcacactcctgggctcaagtgattctcccagctcagcctcccaagtagctgggactacacgtgtgtgccaccacacctggctctctttcctcaattttaatagttaaaatttattagggatattaagtgtttaggtgagataaatgttacaaatatgtttctcccactttttaagtatttattattattattacattttttaatttttaatttttgtgggtacatagtaggtgtatatatttatggggtacgtgagatgctttggtacaggcatgcagtgtgaaataagcacatcatggagaatggggtatacatcccttcaagcatttatcctttgagttacaaacaatccaattacactccttttttttttttttttttttgagaaggagtctcgctctgttgcccaggctggagtgcagtggcatgatctcggctcactgcaaccccgcctcctgggttcaagtgattcttctgcctcagcctcccgagtagctgggattgcaggcatccaccaccatgcccagctaatttttgtatttttagtagagacagagtttcaccatattggccaggctggtctcaaactcctgatctcaggtgatccacccgcctcagcctcccaaagtgctgggattacaggcttgagccaccgtgcccggcccaattaccctcttttagttattttaaaatgtacagttaagttattattgactatagtcactctgttgtactgtcaatatttttattattttaaaataaattttattgtatatatttgaggtttacaacatgttgtaggatacatatattaatagaaaagttacagtagtgaaggatattaacatatctatcatctcagatagttaatttttggtgataagacagcagctaaaatccacttatttaacaaaaaaccctgacatacaatataattttattaactttagttctcatgttgtacgatagatgtctaaacttgttcatcatacacatctgctgttttgaattctttgacctgcatttcccattccccggccactcccccacccaacaggtggtaaccactgtttcattctctttctgaatatttgagctctttttatgattccacatagaagacccttactgtctttgaccacttacttgatgatgcctcaagggagataacacttcttgcctaggaagctaaaacatcttgcctatcaatgttcaggtttattctcctaggttttaatttttgtcacacatccagcactattacttgcatactgatttttgggacagtatgggtcaaaattgttcacaaaacacaaaataaatggataaaagagaagccaacaatatggagacatatttgctttggtagattggctgaaggtgatggtgctctatagtagctgaggcccattagccaagaggcacagtgttgtgtcctgggtcggttttactgcttgagaatgcgttctgtttcttgggggatgaacacacacacaatactgaaacagatgactatatgtgtggaaataaatacatatgtttggggatatttcagagacagatagtatttagaagaatcagcacagggtgtggtatccttaagcacagtagacgtggattccagaatcatgccaaattacttgcattcaaatcttttaggtttggcttctgaaggaactcaacctaagacatttgcaatagcaaagactttcatatttgtgagaagataattttagattatactaagactataaatttagttgggatgctttccttgttccttaattaaggtacacagtagggaagcatcttaaagaataaaatgctaatgcattatattgttatagtatctaattcattgtttgaacaagatgaacattaaaaatgataattatatgtataatcagtttataccaaggttgttagagtgaattgtttactggagatatgaggggtgattatcatatcactctagcctcatatactatgatgttagtaattcttagagtaatatgtttataaaaactccacaagatgtaatctgggtgaggagtttgcaagctgagttggcatgatttggataagaccgaatccaaattagtaagttaaatgtagaatacacagctaggaagactgagggtcacttgagctgcatatggagactgtgggctaagataggtaacgagattttcacaggtctcagtatacaagtcctagactcagcagattaccatccaattccgtattaacaccttgagctctcgtacagtcttttgttttttttaaatcaagttttcccttgtaatggtagagtaaacataaatttcacacttatgggatgagcatacttcacaaaaggaagcaaagctccttaatggggtaattgttagtgtgtaattttggtttgagttgctgaactagtgaataatctcagggttgccctcctgaaataatttgaaattgtgtgatttttttcttttaaatctacctctggatttgttatgtaggactctaatgagattaaaatcctataatcaagaacagaaatgtcattcaaaatgagaaagccggtaaaagaatgggctaataacaatattgggtttgattcatgatttgggagaggggtttaaaacatttatatatcatgtacattgtaaaaagagtgtttttaagtcagtttgtgtagaacaccctcttgaaagtagttttgacctcaaggttgttggggagattaaggagatcatgtatagctagtgcctggcatctgtttgcatataccagttctcataatggttttccactgctactattcctctgctatgacttctatattctgctaaaagctttgagatccaatagttagttcataactcacatgatggcaaagcctaacctgacctgatttgaggctattttcaaaatcatacttagtgtgaatacttgttcgtttgttgcagaaatgttagtgtgcttgattttggaatgccattccagacttcattgggatgttacataacatacatcctcaggcaccattttacttttgtaaaatgtgaaaaattcttaattccaagacacatccagctttaagggtttaggctgagggattgtggacctgaagtcatgttatcatccaaaccgggcaaccttgattcattaccatggtgcataagcacatgaggatgctgataactagggctgtctgcaaaactaacagcttctttcgggtcagtggccggacactactcaattgcaacgatcatgtggcataaagagaaagttatatatttgaagcacttccaatgcgggaaaatcatttgtcaatttaggccacgtataggtctgaatcttgattggtcagaaatgtatcagaggttggaaagaataaagttactttttgtaagaagaggttgatatgtcagtgctagatgccacgagttgaaatgacgtaaggctccttctgatttcatgctgtgggtgatgatgtgagactctggctgcattcatggggaagggatgaggacaagtcagcagggggcagctgctcagccctgggttacaaacaggtttccttgccttctgccatgcagacagctttgcaaattcaatctactaacattttaaatgcatcttcactctttcttccaaaattattggaatggatccttaactattccctattttgttaggctgagttgtcaaggcttttacttaatttctttcaggctgtttaagtagtcaaagtattcattaatttagagctttctccaaatatttgacatagacatcattttcctcaattacctagacagttctacgcaagataattttttgagggattctagatgaccaagtatgtactttagctctccattttatagatgactacaaaaacaactattaagttgttgttgtgtgtgtgtgtgcccacatttgccaaatcatgaaaagatcactttcttggggagaacaaaatcatggattgtttctaagggttcttactaatgaatagtattacccaaactccattagatgagctgctaagatgcattgcacttgtgaaaatttggtacatcacattaattgttgtagcttaagcactgaagcctgctagggacagcatataattattttttaaaatgctcctagtattagtttttttgtccctcagcatatttgcctattggtgaaacttcctgaaagtagttaaaaattgagggattggatggatcatgaggtttataagatcatgataaatctgtatcattgacaataagctaaacagttgtcacatatgaaataatgttacttattcaggccatccctgatatgaaatgcagaactcttaaagagagtatgagatagttagatacatctagaagcaatttttggtgatcacagttgacatttttatatacaagtttctttggtatttttagaagtatattaactttccattttgaactattaaatattacataataactatatcatctgtggtcaggcatcagaattaatgctctataactgatgagattactccagaaatgtccttgagaatttgataaaatgtataagtgaatttgaaaatttcacatagtgtatttatgcaaacatctctataataactttgctctgaatattataatagcttctatgactattcaggattctctatttaaaagattaggacttggtgttgagatttcttatgtattatttggctgttgcacatattaatatccttctgctaggagagcagcaatggtggtttgatttcttttggatggtttgctcttgatatttgttgggttaaagtgtgatttcatttgtggctgtatttaaattacttgggaagccatgtggtatagtgtagtacttggatttcaaagtcagacttgggtttgaatctactgcttactagttttgtgacttgggtacatttcttactatttcaaagatcagacagcttcttcaaagtgcaaactaactaaacttatatttcagataacttgttggcaggatttactattgtgtttagaaagcacacaggaagcactttataagtattcattctcttcttccttttctgtctcctgaagtctatagttattgggaccactgttaggcatttatcatagaataacttatgtcaataattatatttttttgcatcaattttattgagatatgattttaaattacaataagatttactaaatttaagtatagaatttggttgctttgacaaatatctatagtcctatatttatcactactatcatgataatgtttccatcacccaaaatgtctgcttgtgccattgtgcaatctccaccccctttttgcctccaaaaccacttgagatgctctctagcactagttgtgtgaacatgtattttaatttgtcttgggtaatctaagaatggaattgctgggtcatatggtaaatttctttctttctctctctctctctccgtccttccctccctccttcccttccttccttcctttcttcctttctctctctctctctttccccttccttccctttctttcttttcttttctttctttctttcgcttttctttctttctttctctttctttcttccttcctttcttctttctttctttctttctttctttctttctttctttctttctttctttctttcttcctttcttctttctttctttctccttccttccctttctttctttctttctttctttctttctttctttctttctttctttctttttctttctttctttctttttttttcagacagagtcttgctctgttgcccaggctgaagtgcagtggcacactcttgactcactgtagcctctgcctgccagtttccagcgattctcctgtctcagcctcctgggtagcggggattacaagcacacaccaccatgcctgtctaatttttgtatttttagtagagatggggtttcaccatgttggctaggctggtctcaaactcctgacctcaggtgatccacccgcctcggcctccgaaagtgctgggattacaggcgtgagccaccgcacctggcctgtatgtttaactttctaagaaactaccaaactattttccatcatggctgtacttttatgcattcccaccagcgatgtatgagagttctagttgctccacatccttgctactacttgatatggtcagtctttctaattttagtcattctagtgatagtggtatcttattgcttttatttgcacttatccaatgatcaatggtgttaagtatttttgcatagattattttccatcttgataccttctttggtgatacaactgtccaaaatttttgccctttctccattagtgttttaatcttctaattattgaattgtaagaactctttaggtattctgggtatgagtctttgcaaatattttctcccaaactttggccttgcctttctaaaaaatagactttaatctaggtgtagctttttaggttaaaaaaagatcttattttttagagttttaggatcacagcaacattgagagaaaggtacaaagatttcccgtgtattccctgcctcacacatgcatagcctcctccattatgaagagtcccaccagagaagtaggttcattacaagtgatgaacttacattgccacatccttgtcatccagggttcataatttacattaggattcattcttggtgtacatcttatgggcttgtacaaatgtataatgatgtatctccaccgcaattatcatttcattctccgtataggtcacacactctttttaggaaggggcatggccctctttttcactcataatatttaacataagatattttaaaagtataacttcaccaaataactactgattgattaatgattagggaatggggtgttttgggtaattccaattatctgacaaccagatatgcaaattccattttcaaagactttggtacaaaaaaaatacacttaaccataaaattgacatcatcatcatcatccttttatgaagataccttttttaatttttaaaatttaaaaattaaaatttaaaattaaaattcaaaatttttatattttaaaaatcatttaaaaaatttttcgtaggtacagagtaggtgtatatatttgtggagtacatgaggtgttttgctacaggcatgcaatgtgaaataagcacacaatagagaatggggtatcccctcaagcatttatcctttgagttacaaataatctaatcacattttaaaagttattttaaaatatacaattaagttattattgactatagtcatcctattatgctatcaaatagtaggtcttattcattctttctatatttttttgtacccattaatctgaagacattttaaagtctggcaaggtctcagaataataattttaactataaagttatatataataatagaagtaacaataatgatcattgttatagctgacattgatgagcatttagtgtgaagggctttatgtacattgtttcatttactcccctcaataactcttggaagtagataaattatgatctactatttatagatgaggaagcacatctagtgggattaagtaacttgtctaggatcacagagccagtccctgatagagacctacacagacagctgatgctgaagccaatactcttacgaacctcttgaatatgagttgagtcataattgccctgaggaaactgaatattactttaaaaatttttaaaacaaaatgcctggtattagatgggtcatttggcacttttgtctttttcataagagtagactgtagacgactacaccttccaaatgagaatttttttctactgctataaattgaagtgttgtgtgatagaaaaaatacaaaaggcttaggcatgttaacttagtaagtaaaactgtatttataagttctctttcttattgtcagataacaaaaataaagggattactttttttttttttttttttttgagacagggtcttgctctgtctcccaaactggagtgcagtggcaagaacatgactcactgcagccttgacctcctgggcccaagatatcctcccatctcagcctcctgagtagttgaggccataggtgcatgccaccacacctggctaattttttaattctgtagagatggggtcttgccatattgcccaggctggtcttgaactcctggtctcaagcaatcctccctccttggcctcccaaggtcttgggattacaggtgtgagccgctgtgctaggctggattatctatttttttaacctttttatataacttataatttttgatgtttatttatttatttatttattatactttaagttctgggatacatgtgcagaatgtgcaggtttgttacgtagatatacatgtgccatggtggtttgctgcacccatcaacccatcatctaggttttaaaccccacatgcattaggtatttgtcctattgctctccctccccttgccccacacccgctgacaggccctggtgtttgatgttatctattcttaattcagatgaatttattatattatttcattgatgaagtggtgacaaagaaaaattctttaagttaggataataggccgggcgcagtggctcatgcctgtaatcccagcactatgcaaggctgaggcaggcagatcgcctgaggtcgggagtccaagaccagcctgaccaacatggagaaaccccgtctctactaaaaatacaaaatgagctgggtgtggtggtgtatgcctgtaatcccagctacttgggaggctgaggcaggagaattgcttgaacctgggaggtggaggttgtgatgagccgagatcgcgccattgcactccagcctgggcaacaagagtgaaactctgtctcaaaaaaaacaaaaaacaaaaaacaaaaaacaaaaacaaaaaaggataataatagtatctactacataaggttgaagtgaagattaaataagaaaatacatataaaggccttagcacagtatcttacagacaacaaatgcccaatgttatcttatagtaacagttctattctcaatgactgttgactttgactactaatatgtctctgaattcaagaataaactttacaaggaaccctagtgcaggcagccttacttaaagtgtaccaagactaactcctgtggattgatgcaaaaaacagggtagtgttaaaggtgtcctaaagggtttatatcactcaaatgtctataaaatccaatggatggccatggtgatgccaatgactgcagggactttgcacaagacattgttccatttgtgctttggtgttgctctgagcctggatctttccaatggaaatcatgcttcttcaagtgcctggaaagtacagtgtgtcacacagatgcctgttgacctggaaggtgcttcctggcagtgactcagccttcccaggaggtaagttgaagctgctcttaacagctggtatgctcttctgaggcttcaccgtaattactgaagtaaatggtatgcaacatatttggcatgtattttccagataatgtacatttccctgccatccttatggaagcctattagtgatgaaactggaaaaggaaatctaataatgagcttctttttcatttagaatgcttttaagcctcctgctactaacagctccaaaaatattttgagattttccgctctgatgtgatttttttttttcagtagcagagccctgtatgcttcttttttatttgtataaatttatgggttacaagcataattttatggtgtcttaggtaattgggtaataccatggatagatggcatagtgatgaaattaggccttttagggtatccatcacccaaataccatacattgtacccattaagtaatcgctcatcatccaccatccacccttacccttccaaatctccatattctatcattccacagtctacatccatgtgtacacattatttagctcccatttgtaagtgagaacatgtgctatttgtctttctgtgtctggcttgttccacttaggataatggactccagttacattcatgttgctgcaaaagatacaatgttattttttatggctgaatagttttccattgtgtatatgtaccacattttctttatccagtcctccattgatatgcactttggttgattccgtatctttgctattgtgaatagtgcaatgataagtgtgtgaaggcaaatatcccttcgatatactgatttcctttcctttgggtagataccccagtagtgggattgctaggtcaaatgttagttttatttttaattctttgagaaatctccatactgtttcccacagtggctatactaattgacattcccatcaacagtgtataagagttcccttttctctgtatccttgccaacatctgttattttttgtctttttaataatagccattctggttggtgtaagattatatctcatttttgttttaaattgcatttctctgattattaatgatgttgagcatttttttcatatgcctgtaggccatttatatgccttctgttgaaaattatctattcatgtcctttgcccactttttaatagaattatttttgttgttgttgggttgagttccttataaattctggatatcagtcccctgttgtatatataattttgcaaatattttctcctattctgcaggttgactgttcactctgttgactctctcttttgctgtacagaagctttttagtttaattaagtttcttataattaaaattttgatacctttttgtgttttggagaaatgtgcccttaaatgaaaagaggacaggctttgggttcagacagagttaagttctaatttgggttctaccacttactaattgcctatctccttaacttctcagggactcagctttctcatctgtaaattgaaaatgacagtatgcttttttccataaggttgttagtgttgatggcacaagtaatgtgaagtacctagtgtagtttctgaaaggtagtcattaaataacagttatgattctattttacttcagcatgaattaaggttcaattaaaatactgctttgggtttatgcctttataagttgaacctctgagatactgccagctctggaaaaattgattttacaaataaattttctttttatgcaaatagtcttctgatttccttgcataattttattctacatagttaacatgttaaaactataaactttatagagaaatggctttttcagatatgcgtctaaataaaaatttacccatacttgtgtggtttatagtcatagcttaaataattataactaccttaggggtgaaaattaaaataatgtatgcaaacattttgctgatacctggaacacagtaaatgcttaataaaagactgccacggtttattataagggccggcaaactttttatataaagggtcagatagtaaatatcttaagctttgtgggctgtaccatgtctgttgcagtcgctcaactctgccattttggtgtaagtagccatacactatacataaatgaatccatatagctgttttctaataaaactgtatttaccagatctgctggtagtttgttaacccttgaattgttataatagtttggcctataagaagtcatcttgaagtactaggcagatcaatcttatagaaaatgggatggttgctttgcaaatactgtcctgtacatacattcttcagagattattgatgttcaggatgtgtcaggtgcccctgcaagaaatgctatagacataagaacaaataaaacaagtccattgtcctgtaaaggccttcttcaaggtaaaaaaatactgatttgtcctaactttacacaaagatagcacatttgatggctggagtattagcagctgaataatataaagctactactaattcccaaagatatgtttaatttttttgcttattttaatatgtattcaattagagaaaactgaaaatatgaaaagttataaggaaaacaccaaaatcccacattgtaatttcactaacctgagctaacaacttttaacacatggatgcatttccttctattctatttttttttaatgactttttggaagcctattttacataccatgtttacctactctaagtatacaactcaatgatgtaaatgtatagagttgtgcaaccacttccagaatccacttttagatctctggtccttccttttattcctgagataaaattgacataaaataaactgtacataattaaatatacaatttgaaaaggtttaacacatatatgcacacacacacacacacacacacacacacacaccccatacatatatgtaaatatgcaatagtcccccattgtctgcaggggatacccccgaacccttgatgcatgcctaaaacctcgtatagaactgaaccctatatatactgtcttttcatacgtatacatacctataacaaagtttaatttataaattagtcacagtaggagattaacaacaacaataataaaatggaacaattgcaagaatatactatgataaaatttatgtgaatgtggtctctctctcaaaatatcttattgtactgtgctcacccttcttgtggtgatgtgagattataaaatgtctgtgtgatgagatgaagggagatgaatgacgtaggcacagttgacagttgtggagttgaccttctaacgacactcagaggaaggaccgtctgcttctggcatccagtcacgacgacctcgacggctggatgtcaggagcagatgatgttgatgactaacgcgtgggtagcataaacagcgtcgggacgctggacaaagggaggattcacatccccggtggggacagagctgaacaatatgaaatttcaccaggctactcagaacagcatgcaatttaaaacttaagaattgttgatttctggaattttccatttaatatttttggactgcaattggctgtgggtaattgttatattggaaagtgaaaccaaggataagtggggactactgctaccaccccaccccccacccacacacaccccagtgaagccatcaccacagtcaagatggcaaacagatccagatccaacattgccaagagtggttttgggcctcttttgaatccctccttccgcctgacctcctcagtccccgggtaacattgctctggtttcttattactatgggatagttcacgttttctagaatttcataaattgaatcatccagtgtgtactcttttatgtctgctttctttcactcaacataattattatgagatttctccacatttcagcaagtatcaatagttcatttctttatatcgctaagtagtattccattgtatgaccatactataatttgtttatctcttcatctctagatagatgttttggatgtttccagtttttcactactacgaataaggcttctatgaacatttgtatggacatatgtttttatttcttttgtgatcatacctgggtgtggaatggttgaatcaagtgatatgtatatgtttgactccttaagacactactgaaatgttctccaaagtggttgtaccaattttacattcccactagcagggtatgacagttctagtttgcatcacatcctcaagaacacttggtatggtctgtctttttaattttaaccattcaaatagctgtttagtggtatttcactgtggttttaatttgcactttactgatgactaatgatgccgaatatctttcatgtgcttatttgccatttatgtatcttttttggtaaagtgcctgttcagaaatattttctacaattgtttcctgctagatatttttttttctttggttggtttgtttttttgagacagggtctcactctgtcgtccaggctggagtgcagtggcatgatcacggctcactgcagcctgaaactcctggactgaagtgatcctctcacctcagcctcttgagtagccgggactacagatgcatgtcatcatgctcagctaatttttgtattttttgtagagatgggttcttgctatgttgcccaggctggtcctgaactgagctcaagcaatccgccagccttggccttgcaaaatgctgagattacaggtctaagcacccagcccaatctttttttgaaggtttatataatcgtgaccacattattaaaagaattttgtatccttcattttcacttaaattttaaaataagtatttcttcaagctataaaaattcttcataaacattaaaattaatagccacattgtatctcaaaatttagttaacaatcactttattattaatgttgtttctattatatacataatatagtgataaatgttaccatgatatatatatgggaattagtgtccagaagcttgatcgtgtgactttgtaccagcattggacaagaataactaactcattgattttgtttctgcactgagtgttatttcagtctttgtgagtttattaaattagaactgtatctcattgtttgcagctttttttctttttctttttctttttttgagacagggtcttggtcatccaggctggattgcagtggcacaatcatggcaaactgcagcctagtctgctgggctcaagccatcttcctggctcaacctcccaagtagctgggactacaggcatccaccaccacacctggctaatttttaatttttttgtagagaactaggtctcactatgtcgcccagcttggtctccaactcctgagctcaagtgatcttcccgccgtggcctcccaaagtgctaggattataagcatgagccactgtgtccagctgcagcttctatttctttgataacttgtgaggttaaagtttttcatgagttcctttatgttttgataagtcccatccattttctgtttgtgttctaaggggattcatccttaactttttatgaaaaattttttgttccaaaatatactttaaaaaatttggcctaatattttacatgccttcctgataacaccccgtactccttcctgaagatctgatgaagtgtataaacagtggtcactcacaggtggcaatctgattttttttattattatactttaagttctagggtacatgtgcacaatgtgcaggtttgttatatatggatacatgtgccaatctgttgttttaaagccacagcatgttaaacccattccccttccatgccccagatactaattaagcataactggctgcttcttatacatttgtatgttcctttttagggaacacattattctctaaataattttcaaattactttgaaaatatttctaaaggaagttagtgaattacaaccaatgatttctctctatggcagcgaggagaaagctctctaaatctactgaaaccctcttcccctctcatttgtgacctgagatgctctctggatgtttcagcaaagtgatagactattccctgactgccgtggcagctgttcttttgctgtcaggcctgtgtcaaaataatggaatcacttaaaataaaaaaaaaattgctgcacaaaataactgagatcaaaggcctcttatctgcctgtgcttgtgagtggaaggaatgagttggaatacttttctttaaatacagtgctctggtgctttaaagtactttggctatttttcagggaatatgtaagttgaaagagagttggtatcactgttgcagtatcatggcgacgtggattgttcttcatgtcctctgttatctgcagtgctgtgtcaccaaacacatacaagagggtggcctcctatcattatgccccacaccagggttaatagtcatttgaggacttaggcatgtgcataaaatgtttttctgtggcaccaccctgggtgcagtcccagaccctgagactggacctatattaagcttgtaaccttaaaccactgtgggcacagctctaagcagggttcactgccatgtgtggcagctgagaaagtgggttacacaccggagggaatatgggggagccatgggcaatgagcagtgagctgggggtggggtgtgacttggaatcagaaggtgacaatttagagaccgagttcaaatgagggaacagtaaatccaggtcagttataaggaagctctgaggacccagcaaacccaccttgggatggtagtggcctgtggagagcctggagaaggtaagagtcagggatctgtgactgtaaaccatagggaccaactctgtaaatcaaggactctattggggtgggattggcggaggtagagatgctcactgcaacagggcagccctgagggcctagcaccaggagcctatggatgattcttcaaggctctgatgtaaggacgaagctgcagctgcttctgttattttacccaagattcaaagtccatgtcttcatcccttctccattcaataaaggcttattagtgcttacagtcaacactgcttaggcactgataatgcatcagtgagaaaaacagtccttgttctcattgagctgacattccagtgggagaggcagataatgaacaaatatataaatgtatgcagtgcagtgatatgcaccttaatgaaaactgcagcagggtgggtgacagcagaatggaagcaggtggcaggtgccatgtgtagatgtgtggaacactgtggcttctgtaaggggtaatatttgggcagagatctggaagaagtaagggagtgagtgagccatgtgcatctgaagaaagatcttccagggagaagggtatctgagtggcctgggttggtcacctgtctactgatgaatcatggaggatggggccccatgaatgacaggctatcaggactgtgtgcaataggggtgacccccaaaggaaaatggaattgcttttactatagaaattcaataagcagaaagaaaagatgtccaccacagttgagggtggtgtttctttcactgaattctgccccaaaacagagagaatgaatgagaaggggaattgtttccacttccaagagatggggacaacaggaatgaggtggacagagaggccttggacagcctctggtactctggactctcaactgaatcccaatgactggtgcaaaagcagagagggaagagggtgtgggaggaaagatacaagtgttcaggagacccgaggatgagcgcctggactccccattctagatgctggagcctgccctcaatagcacagtggacgtgacttgttcttctactgccatctgggaaacaacagaagaccatttccaaatgctattgcatggtagagggagccagttctgtactgccgtcaccctctagggcacgcagagaagagggactggcagcctgcatgcagctgtgtgtgcatcaaagccacaggatgggcctagggtgcaggcgatggtggtcactcttctctgcctctccctgagtgtggccagttgcaattccctgaatacaccatgcacgttcaaatctgtgtgcctttgcccatgtgtgctgctcagcctttagtgtctagcatccatgaagccttctctgtcctccctccccaactaattataacgtatcattcctttcccacagtccacagcatataattggtgcttgttgcacccactcactgaaccttggatcatggtgagttttacatgtgtctttcctggaagaaaatgcatcagttttgttcacctttgcagtgagccctccctgtcccagtgccttgcatcacagagtgcatggatgagtgggtgatctctgaccttttagggcataaggccaggaaggaggtgactatgcagccctacatgatgctggttttgattgggcccctcagtttcccacgtccagggaggcccatggctccctggctgaccacggttaggagctccagaatcatttcttttcctttcctttcctttcctttcctttcctttcctttcctttcctttcctttcctttcctttcctttcctttcctttcctttcctttcctttctcctccctccctccttccctccttttttttcttttcttttttctcgctctgtcacccaggctgaagaacagtggtgcaattatagctcactgcagcctcaacccccatcaccccacgggctggagggatccttccactccagcctcccaaatagctgggactacaggcatgtgccaccacacctgtctaatttttaatttttttttgtagagatgaagtctcactatgttgcccagggtggtcttgaactcctggactcaaatgatcctcctgccttgacctcccagagtgctgggattatatgccagaattatttcttgtgattcaggggcatagatttccaggcaggttgaattattcaatatagattgtagagttcagagagttgttccccgaggttgcaagtgatcccatggaacaacgctgtttgagataatccctgatgcagccctgttgggtttttgtgatgaagaaggaggagcatctctgaattctgccaggaatgagggcagcagtcttgatgagtggtgaagtagctcccagagaatgttgcagggtgcaatttctccccatctctagagaagccattgggaaggtcaacccataggaccctccccagggccaggctggagctgaataaagagccctctggctcgtcttagtgtcagcagttattcatcagagaacttgaattagaactcacatttctcattactggataatgtgagagagcaagcatgggttccagctaatcaaacatgccatgtgccaagtgagcttgagtcctggagagaattaactctaagcctcttaggctaccatcctttacccactggatgagcccgaggggcatctggggcagcagtgacagagacctctgggcaagatatgcccagaagaggtgtgatgctgcgcccagcttctcatgagcgatcaccaaaactgatcacaaaatatgcaccacataagagaagagtaagataaacactgttaaacaagatcatgtaagaagactaaaaaaggaaagaaaaagcattcaacactaaaaataaagtaaaattaaggaatataacaaaggtttaaagttctaaaatcaagataattgctacaaataaatttagcctaatacaaacagcactaaaaaagtaggcaaacttaaaagtataggagacagaaagtaacaacacattcaaaagaaaaacatgaaagttaatttttaaaatataacaccccaagaaatgttttaaaagataaaatacatttaaaatgatgtaagatcaggtggggcgtggtggttcacacctgtaatcccaggattttgggagggtgaggtgggcagatcacttgaggtcagaagttcaagaccagcctggccaacacggtggaaccccatctctactgaaaatacaaaattagccgggcgtggtggtgggcacctgtgatcccagctactcaggaggctgaggcaggagaatcgcttgaacccgggaggcggaggttgcagtgagccaaggtagcaccactgcactccagcctgggtgacaagagtgtaactccatctaaaataaaataaagtaagatcaaaagctaaaagtgaaagagagattagagtataataaaggttaaatctgcaggagaaagttaaaaatgtgatggtaaatgggattaaaaatagcagttaatgtgctttaatgtcaaaagcagaagtgatcatagaataaggggaagagtaatttaagaagaaaatgaaatgcaagttctgaaggtccaggagcttggggcagatcagtgcaggaaacactggcgggggcagtgaggaggcagctaggaagctgtggcagggccaggcttcttgagagccacctctcggctgaggcagctgtgatgtccaaggccagggtgagatggagagctggctttccctgttgaaggtggcctttttggaagggtctgaaaagatcagaaacccttcccatcataagtggcttcttaactccacgaaagtacacagctgagctgggaatggatttgcgacaggggcgggtgtgtatatgtgggtgggtgtcgcaatctttacgttggggtctgcttcattaaaaaaatttaattaactaattaattaattataaaataataaagatgggtctcactatgttgctctggctagtcttgaactcgtgggctcaagtgatcgtcccacttcggcttcccaaagtattgggattacaggtgtgagataccgtgccgggccgggatctggttctttgcagcatatacataataaagcttcaaataggtcatacaatcttcagagcaataatctcagctagatatttgtaacagcataaagctggcgtccataggggattgactatgaagtataagataaccacccgatgaggcaccatttagacatagcaaatgttatggaagaatatttattgacatagaaaaagctggagatagctacatgaaaaaacataattacggaacaataattactgtgtaatctaactatttaaaaagtttatacagtagatgaatacatgaatagtatgaaatatttattactattgttattgtcactgtggtattatttgggtagtagagattgtggtgattttttaaaaattattttttgtgctcttgagagttctccctaaataaatccatcttatatttagtaatcattaggaaaaaccctaaagtttaatttaaaataattatagcaacaggcatagacacacacgtgttcaactccagaaagataccctacactggcctttctgcaaggaaagaaaggccagatgttctctttcccaactcccatctccccagcctgtcacaaaaaccagttcctggatcaaaaataatgaatccagaagagataacttactaagataacataaaggtgttaagtatgtcatgtattaaataatgtatgtatgttatctatacaaaattaatatgtaataatagttattagagaattaataggtaattattcaacataaaaatccaacttaatatttcttctatgtttattatattaagcaggttatatgcataatcttattagggctcagagagagtgacttttgacatggcacaggtgtgggggctggggtctgatctgaggatgttcacttcagtgcttcctatgtcaatagttcagtattttaggttttggggcagattcagaaaagtgtgattcatgttgcctgccctcaaagtctgaagtctgtctaacctagctggaaagatggaaaaaagtgatgaatgggtgtgtagtgataatacacaacataataaagtgggcagtgcagataatacttgatgtgagcacctaggacagacattcctgtggcctgtgtgggtcaggcgagtcctcagtgaagcagtgggctctcaaggatggggagtgtagcccatgtgggtcactgagctagctctaggtcaagtgtacacaggatgttctggagaaagaatgaccatgcgaccagcacatagacagcagactctggggactaggtcaagcctgaagggatggtaccagaagatgtcagtgtgccgactgagtgaacggggtggaagcacagtcaggagagaaatcatgtccaaggctgagggaggcaggctgtggtcaaggtgaggacagacatgttagacgagcagtgaagtaatagcaagagaagggaaagaggaatgatatggcttcagttgggttggtatctgctagggactgaattgtgtcccccaaggattcatatgttgaagccttgacccccagtgtgattgtatgtggagagggagcccttagggaggttgttaaggtgagatgaggtcatgtgcctggtccctaatctatgaggtccttataagaagaggaagagacaccggaacgctctcttcctgctcgtgtagagagaggccaggtgaggacgcagcaagaaggtagccaaccacaagacaggaagagaggcctcctcagaagccagtgccgatggcaccttgatctcagactccaccctcttaaactgaggaaatcaatgtcggtttcttaagccacccagcgtgtggcattttgtcatggcagcctgagatgaccaatacagtctaaatctatataagtctaagtctgtgactatgggcaagtgatgggcattcctttgatgtgtaacctgtacatcttgccaaggttgggaggaggtacacccagagaaaggaggaaccagagacataggataagaaataagggtcatggtcattcttttgatcatgatatgtaatcaatctataaaaaattcatattgaatgcctcccatgtccaaagaggcaaggtcttactctgttgcacaggctggagtgcagtggcatgatcatgactcatgcagccttgacctcccaaactcaggtgatcctcccacttcagcctcccgagtagctgggactacaggtgcgtgccaccatgcctggctaatatttgtatttttggtagagatgcagttttgccatgttgcccaggctggtcttgagctcctgagctcaagcaatcagcctgcctcagcctcccaaagtgctgggattacaggcatggggattacaggccacaactggcctaaaacagcttattctttttctttttctttttgttttttttttttttttttttttgagatggagtctcattctgtcacccaggctggactgcaatggcacaatcttggctcactgcaacctctgcctctcgggttcaagtgattctcctgcctcagcctcctgagtagctgggactacaggtgcctgccgccatgcctgactaatttttgtatttttagtagagatggggtttcaccatgttggtcaggctggtctcgaactcctgacctcatgatctgcctgccttggcctcccaaaatgctgggattacaggcatgagccaccatgcctggcctaaaacagcttattcttatatagcctgtgtgccaggcattccacatgctttacaggtattaactcctttcatgcctatgataacctgtgagtaaatatttctatcatctcagctttacagatgaggaaacaggctcagagagcttaagcaacttgctcaaggtcctaagattgttgagaattggagctgagatttgaacacatgattttggagtctgtgctttatccactatgtagtactatgtaggatgtgattcctgctgtcaaggatgcagagtttcttgaaaagatcagatataaatatttgacaggataaatagaaataaaaagtagggcacatttaatctcagatgaatggaatgatttagcgtgctctcagaggggagtgggcactccattgcctgtaagataatccaatggggtgcaggaaggacagattgggacttctatttgtgtttatattactggttcattgaatagcccaaacttccaagttcttcatcaagagagaaaaccaatgaaggtgtaatcagatctgttgggacacagtcaaaaaacatgaaatttatcaagttcactgcatgaaatatgggttgatatctgctgttattagctaagatgtcaggagctggtgtacactgaggaagagtttcatcatgacatctactgttgttcatgacagtagagcgttcactggctgaatgggagcagtgagagtaacgagcttgtgagtgcagagggctgtgtgcctcctccatgcgcagggcactggggacatagcagtgagcaccactgaccagcatctcttgaggagcttatgttccagttggggaagacagatgataaacaagatggacaaaggaaatatgtagtgttaggtggcaatatatactaggagaaaaataaagcgggaaaaggggtggtaagaattgggcaaagagtctttaatttttagttgaggtggccatgtcaggcatcagtgagaaggaactgttggagtaactaactggagggagtgagtgaaggaaccgtgtggccatgtggcagaagagcattcaaaacacacacatgcacacacacatgcatacacacacacacacaaacacacacatgtgcacacagagcaactggtaagaccctaaggtggagatgtgcctggaaggttaaagaacgaggagaccagtatgactggagcctagggaacagggagtgatgagagatgaagtggggagacaaaggagagggtgccaatgtgtcggcacgtccctgtagctacacatgggtttcatgctgtgagtgggatgggaaggcactggagggtgtgagccaagaagtgacatgatctggctcatgtttctagaggatattaaggctgctgtgttgacatacattgtagggaagtaagggcagaagccaggagaccagctggaaggcctagggcagttttccagatgagcctggaccagagtattagctatggaggtgagaaggggctggatgctgtatataatttgatgggagaaccaacaggatttactgatgcattcgaagtcagctgtgagagagagactaatagtacctatgcattacacagaaaacacttccattcaagataagtgcttaaaaccttttacttctagagatgcatgatggagtgtgagggctgctagaatagacaaaaaagagtctacagggattctgaggagagaggccacttaggggaggacagtcaggcctggacttggttggaccttgaagaataggtaggatccagagagttggaaaggcccaggcagagtatggtgaggtcagcaaaggaagggacctggttccacctaggcctgtgctgagcatggggcctggagtacaggctttagatcttacagttttaagatagaatggtagcaggaggccggtttgtcctgcacttgaactccaggtaggacagtttagacctttaccttcagtcagtaggaaggactgagagttttcgactggaagagttgagtggtacgggtttgcttcaacaatttacttctcttataagctctgaatgagaaccattggttaatccactaatgttagtgcagtagccagaaaggcttcttctagccagaaatatttcttcccagagaatgacttatttactaaatgggaccaggtcaagaattatatatgtatatgtgcctctgtgtgtgtgtgtgtgtgtatatatatatatataaatactcatacagagtaatatacatatacacacattcttatataactgtaatataccgtcatatatgtacatgtatacatatataattgcaatatactgtaatatatacacatatacacatatatgtagttgtatatgtgtgtatatgtgtgccattgtgtgtgtgtgtatatatatatgtatctgtatacacacaggcacacatatacatacatatacatacacaggcacacgtatacatacatatatatacacacaggcacacagatatatatgggagtgattccactggacttgcttgctatataatagaaataaatgtttctggttacttttccaaattttaaaaagctttatctatattttagggagtagttaagggtttttttggtgaatgctatttaatgaattttcctcttactggatattgtgtgtctggcctgtacacatcctgcacaatcccgcttgccactccaagatgttgcagtcaggtgcacctggcataaacactatggcggaaatacccttttccctgtctgtgtgtgtaagatagcttctttcatgccagaggaactattttgggagaatgattcatgtcacattttggcctcattacagttttaagttgttaatgatgccggtttgtctggaggtggaaacataagtgttgtcttcatatgcgtatgggaatacctataacagaaaaagtactttctattcttgagttacagtctagactataaacaaagagattaacaagatctttatcaaaattctaattttattgatgagaagcatgcttctgaaaaagtacgaattacttgtggctctgcctccattctccatttccaaacacagatggagagtcaaagaacttaatgtcttattgttacaagcagatgattctataaaataaacactgtgctttctcttttgaaatagtgtgaaaagtgagagcaggtgttaaattactgtcttgctgtttgtggttaaaagtaacaggaggtacaaaatcattcaaagtgtatttaggtgtgaatgataaagtaaggtgaagccattctaattattccactttgctttctggtaactttaaaggatatggcaaagcttccttatttactcagtggttaacaatgtatgctgacattggaaatgaggaactcttaacatctgagtttgttaccaggccttgtacacaacagtgccataaaagtgtttattggctgggtgtggtgactcacgtctgtaatctcagcactttgggaggccgaagtgggtggatcacgaggtcaggagttcgcgaccagtatggccaacgtggtaaaaccctgtctctactaaaaatacaaaaattagcccggtgcgatggcaggtgcctgtaatcccagctactggggaggctgaggcaagagaatcgcttgaaccggggcagcagaggttgcagtgagccaagatcacaccactgtactccagcctgggcgacagagaatccgtctcaaaaaaaaaagtgtttattgatttgtcccaaaataactgagttcaaataggaaaaaattaggtttggaatgtggctagatttttctatgattctcaaggaattccatatcctatcttaaaattttaaaattgacaaaatattacttattttataattttaaattataaaagtgaaaattgaaaaataaaaaattaaaggaatgctaatgaatttgttgttgtttgctatacaccctttttttttttttttttttttttttttttttttttttggagtcttgctctgtttcctagcctggagtgcagtggtgtgatcatgcctcacagcaatctctgcctaccaggttcaagtgattttcccacctcagcctcccacccagcatagctgggattacaggtatgcatcaccatgcctggctgatttttgtatttttggtagaaatggggtttcaccatgttggccaggctggtctcgaactcctgacctcaagtgatccacctgcctcagcctcccaaagttctgggattataggcatgagccactgcgcctggcctgtttttcttttttttttttctgagatggagtttttgctcttgttgcccagactggagcgcgatggcgttatcttggctctctgcaacctccatctcccaggttcaagcgattctcctgcctcagcttcccaagtagctaggattacaggcacgtgccaccacacccagctaattttgtatttttagtagagacgaggtttcaccatgttggccaggctgctcttaaattcctgacctcaggtgatccaccagccttggcctcccaaagtgttgggattacaggcgtgacccaccgtgcctggcctatatgcccattttgatggcaagatttttggatacagtgacaacctttttgatacactggcagtgagacatactctccccaccccctttgggcatgtgctttaaaaaattattttctggttcatctgtggttggtgctttccatttggaacttttgacccatgccatttaggtagatttattcatatttgagtaagatacttcaattaacagtaaaccaaatgcattgtaacatcttatttaattctaacatggtggtttgaaaaaatattagcaatgtgaggacacttaagcagttttgtcaattcagctgaatccagcctcatagcaaaatctggtcttaaattccctcatcgtgctagaatcttctagctatgatgagtgaaacctactttttcctttttttttccttatcttagacataaaaaaaatcttctcttggttattcagtgactgcctcattaactagcctgggtctctatttctagaaattagaatttagtggttctggagtggggtctgaacacttatattaaaaaacagggccgggtgctgtggctcatgcctgtaatcccagcactttgggaggccgaggcaggtggatcatgaggtcaggagatcgagaccatcctggctgacatggtgaaaccccatctctattaaaaatacaaaaaattagctgggtgtggtggcgggcgcctgtagtcgcagctactcaggaggctgaggcaggagaatggcatgaacctgggaggtggagcttgcagtgagctgagatcacgccactgcactccaacctgggtgacagagcaagactctgtctcaaaaaagaaagaaagaaagaaagaaagaaagaaagaaagaaagaaagaaagaaagaaagaaagaaagaaagaaagaaagaaagaaaacaaaacaaaagccaccaaaaagctctcccaatgattcttacgctctaagaggacaataggttaacaaagggcaagcttcaaaaccaagatgtagacatggacacaaatctccaaaggtctccgtttttggaagttaactggattgaactgtgagatgtctgtggtatgagagtgaaatgagagaactcctaacatgtaataaaacgtcgctgtatttcacatttccccttctgtcttctcagccatcatgtatgtcatgggagcacttggccctgcagtgggatatttattaggtggacttcttattggtttttatgttgatcccagaaatcctgttcaccttgaccagaatgaccctcgtttcattggaaactggtaagttctgttttctaatttttaaatttcagttcttactaataatagttaaagtcatggtacacttgtatttaaaatttttccaatggggagacaaaaaatagctgaaaggtgcctgggaaggggtgacaggcaggttaataacatcccaaagaaagctacgtcctaatccccagaacctatgaatatgttatcttacatggcaagagggactttgcagatgtgattaaggactctgatattattttagatgacctgggtgggcccagtgtaatcaaaggaaagacggaagcaggagggcaagaatcaaagaaggagattcgatgattaaagcacaggttggagtgttgtgccttgaagatggaggaaggggctgcgagcaaagaatgcaggtggactctagaagctggaaaagcaaggaaatgggttcttccccagcctccagccctttcaaccattttacacttctgacctccagaactgtgacatgaatcagattgtgttgcctgaagccacgaagtgtgtggtaacttcttatagcagagagcttatacagagggtttggggacactggcttaatccacattctttaggattggggtgcttcctttatagcagagtgaaggaaaaggactgctgtggctgcgtggggactttcctgctgactttaatcatacctttcagtatcttttctgtgccttaaaaaaatacattgttttcactttcttattgtatttggtgtctgctttacaaccctctcccactgcctggaatgccagtcctgcttttccattgtcacactctcagtgacccttttttcttgctaatattttgtttcctcatgtgtgctagagatttagctgctttctcgcttgctaggacttaattgtcctggaaaataagtaatgcttaggactcagaatgagaacttcaactttggatgttatgttatttatccaaataacagagttgcgtttgagttcttgcagtcctcaacttgaacatgataagttatttttcacaattgcaagcactaactgaaaatattggtgtcctgaattcatttcatgtggattagcaatatatatacattgataaggcattttcactttatagttaagagaatacttcagtattagaaaagatatgtgccaagtaattactcactcacttttttttggaacatagacacacatggagaaagtaattactttctaaaaaatgtcttagagtactttattctctctgtgtttcattacatgataataacatcataactccgaggttggtaggaataatgtttaacactattgattttcaaagcagctaacagatattaattgttatacacacttcctattttcataagtaatgctctttgaagctggaagtgttatgtctggtagaatttttaaatcatacagaaaggagttcccctgtcagcattagggaaataacacaggagttttaagttcttgactcatagtgaaatttttggtcttgtctgttttctttccagttctgaaattaatcagagtagagatgtttttcattgtcagaaaaccagattaattaactctatttatgaacatccagcatatgttctgtgttctatttagaggtccttaaggagggcacagtgacagggaaacatctggagggaaagatggggagaaccaactcaggtagggagaaggagggaaggcaggagctttagtcttaccagtgctttatgccatcttttgaactgtttttaggagatgttagtccagttggcagcaaaattgagagatgagggccgggtaaggtggctcatgcctgtaatcccaactttgggaggctgaggcaggtggatcacttgaaggtcaggagttcgagataaccctggctaacgtggcgagcctccatctctactaaaaatacaaaaaaattagccgagtgtggtggcgcatgcctgtagtcccagctacttgagaggctgaggcaggagaatcacttgaacctggcaggtggaggttgcagtgagctgagttggcaccattgcactccagcctgagtgacagagcgagactctatctcaaaataaataaataaataaataaaattgagagatgaagagtatagaccctgaatccatattcccctgggtttaaaccctagtctgccacctaatacctatgtgagcttggggaagttactctgtgcctcagtttttataatccataaaagaaggtagttatggtacttattatcatagggtcattgtgaggaatgaatgagtttacatgtctagcactctaagttgttcctgctgtacagtatgtgttagctattcagtcctttgaatttaatcagtgctcaagtaattttatccatttttaatggctcaatgttagttctatacatgataaagattgtcaatatagaaatatataatgagggtctatttaaacatgaatttgaattttattgagtaactgcttgtaacacacttctaccttgaacaaagacatagttatttgatgcaatgttattttatacgatgtctagcagcagtgataagttttcaatgggcacatgctgaaagggagaaggaaggaaggaaggaatgaataatgctaaaatgtattgggtgcttattttgtgtcaagcattatactaagctctacagacattctcatttaagccttggaactaccttggaacaaccataggtagtcactggtatgtgcattttgcagctgaggaaattgatgctcagggagttcaataattttccattagcctcagagtcagtgagagctgggaaaagaaactgactccggagcacagctctcagttcactctcttaactggcccccttagtgaatggtctctgagtcatggttcatgaaagggatttaggtagcttggcttttcaagtgtagctgttattgatgtgtctttttccaacaggtactgcacactttcttgtctcagcttttctcagagtcctctttagcatcattattatatgatgtgttgtatcgatgttatttgagactgttgaataatgtgagttggtttgctctgctttgaagtgaccccacactttaatattatttttgtatttttttgtttatttgctgtatttctccccttcctgttatgcaccttcactttgggctattatgagtaaatttttaatgtttgcatataatcttaagttaatggctggggctgggatgggcagggaggttgagtgcaatgctatgtaaaaagcatgccgggtgcggtggctcacgcttataatcccagcactttgggaagctgaggcgggcagatcacttgagcccaggagttcaagaccaacctgggcaacatagtgagaccccccacttctctacaaaacagtaaaaaattagccactgcgcctgtagtcccagctatttggtaggctgaggtgggaggatcacttgagctcgggaggtcaaggctgcagttagccatgatcgtgccactgcactccagcctgggtgacagagtgaggcactgtctctaaagaaaaaaatcaagataaataaataattaattaaaaagcaaaccagacacacaaaactagctatcatgaactgattgttaatttggggacagatgttttatgacatccatcataacactgtcttatttaattttgatgatccccaaacatacttaataccccacttgtagataagaaggctgatttggaaaagcaaaataattttcacaggatcctatagtaagcaagtggtaaagacaggatacaaacccaggtctgcctgaagccacagcccatgagttgtcccctacactacactgcctgccgtcttctggagagagtgtgagagctcagggagctgcagggattcaggggactggaatggagagttcgtggagagaggctccagaggcaagtgagcagtgcctgatagtgcctgatgggtaaggacctcgtaagcagccaagtactaagagggccaggcattatcatagctatgttctctatagacagatgacctttttagttatttttattttttttgagacagagtttcactcttgttgcccaagctagagtgcagtggcaaggtctcagctcactgcaacctctgcctcctgggttcaagccattctcctgcctcagcctcccgagtagctgggattacaggcacttgccaccatgcctggctaatttttgtatttttagttgagatggggtttcactatgttgggcaggctggtcttaaactcctgacctcaggtgatccacccatctcggtgctgggattacacctcaggtgatccacccaaagtgctgggattacaggcatgagccaccgtaaccagctgacatttttaaaattaaaactgtctctttcaatttatttattcagcatgtttttttgagtacctaatctgtgtcaggcactgggctggtgattacattctgaataactgagattgctggaagtctgccccgaacaaacttctcaaaataaagccctttactgactatcttaaaatcttcatttgatgtaactttaaatatctttgaaaatagcacactaaattattaatgactaattgtaggaatcattctctcaactgtgacctttagcagctgataacagcactttaatagaaacattattttaaaaaatgaattttcactttgcaatggatctatagtcttacctgattgaattcagcgttaatacttatgatgctgcttgcattctggttacagttgatgggaatgtgttgagcatttatgaacttggaagcttgaatggcagagtttggaggtgaggaatcatagttagaacgtggctaccctgttagggagtgccagggacctctgattgctaaggaaatgttgaaagggaactgagaaattgccccacggggcatcatgcagtcaagaagcccagggctctaatactacaatttcattctactccctgtgtttgcttcctagtgctctgcaacgtggcaatctcaggtgaatttcacgacagaattctgagtctaatagctcctgttctacttcttttaggaagctttccgatacacattaatttcccctctctgaattttggtagcactcataatctgtaccatataacctaatatttaattatatacattttgcatttcttagaggtttcttatatttttggcttgcttatgaacaggttgtaggttcttgaaggcaaggactaagtttaaatgtctttgttggtaaccctcatacttggtgaagtattgtgaaggccagctaagtgggaggcaatacattctctttttattttttttaagttttgctctgtcacccaggctggagtgtggagtgcagtggcctgatctctgctcactgcaacatccgcctcccaagttcaagtgattctcctgcctcagcctcccgagtagctgggattacaggtgcccaccaccacacctggctaatttttgtatttctagtagagacagggtttcaccatgttggccaggctggtctcaaactcctgtttcagcctcccaacgtgctgggattataggtgtgagtcaccgcgcccagctgggtcaatacattcttaagtgtttgcagaaaaatatttgaatattctcaataatttaaaacatatttcacatgggatattaatgcttttcttatgacaaaaaaaagtctatattggtccacataacatgctattgtctacattatttttctattgaatttataatttagggatttatcataaaatacacattgtagaaggttagcaatgctagcagaactaactcattggtgctcaaaaatacttgaatgaaattcgaatcaggttgctgattataatattcagtataacactggtataattattgagtagatttctcatttatatcacagaaagagagaattccttcattttcttagtttgctcaacttcctactgctttacagttgattacaaaaagttttcttcaaaattttttcaccacaaacttctgctttactaatttgttctcactcacaaaagaaaagacgtaaatgctattcacattttccaattttttaggtggagtggattcctcctttgtgccattgcaatgtttcttgtgatattcccaatgtttactttcccaaaaaagcttccacctcgacacaagaaaaagaaaaagaaaaaattttctgttgatgctgttagtgatgacgatgttctgaaggagaaatcaaacaacagtgaacaagcggacaaaaaagtttcttcgatgggatttggaaaggatgtcagaggtaaagtatacctcttgaataaatacatgcatggcactttgatcagtgctactcatagtgtggtcccaggcccatgctgtctacccactgtctgtggccagataagtactaagattgagagtaagtgttgcaaaactcttagaaacttgacagagtaatttttttgcctgttgcatctaagaataatttaaaaattaaggttatattttgtatgttatttaaaaattaatttttaaataattcatcatttgtgtattttgcaaaagtattagtagatgacagactagaaataataatttaaaaaaatggtttttcctcacacacagtttgagaagcactgatttagatcataaagaaacagatgtctatatatgttatttactataattagagatgtctgatttttaaaatattaaaaatcaagtgcattgtgccatggagggtttatttcaggggaatagtggctttggcagtgtggtttgatgcctacataagtataatacctaccactagaaagggatctcacttagcagctctgtcaaatgcttgcatgtggccccagagaagggtggccaggggatggacctccaaatgcagtgtaaaagcatccagaaggtcttggtgatatatggtttattttttttcatttttatttctcttaaaaatactgattatattaaactagattaggcaatctataacctaaacaatttgaagtgatcatgaccagacaatatttgttcagtatttcatatatctgttgaatgacaataagtccctttaattccagaaacctataatgtgacactcccattagttttagttttgtttccaacattctctgaattgatttttttgatataaattatgaagcataatatttatcaagtactttcatcagtcaaggttgtgttaggtaaaatttacctaggcacattatcatctcgttttgactgtgtacacagtgtggccaaagaggaacatttccagcctggaataaagttactcatatgttacagacatgtcgctatggcctaagaacaataatagttagattggaccatttttaaagactgtaatttttgaaagcaaatgaagtgctatttcattgaaaatgcctctttccagttacattttagatgtggccctctcccttcccatgattttgtgacagtgtgcacttttggaactgtacatgacttcttatgctctaataacataaagcattctctggatgctggcatggcctgatctcttcccatgtgcaccagcccaacatttttgtgaacctattgtagaccattatggctactatcaaaagagtgattttttttcacaactcaattgagataaggttgatgtcaaagaatttaaaacatagcaataatctttgattcttttttttttttttttttttttgagataggtcacccaggctggagtgcagtggtgtgatctccacttactgcaatctctgcctcccaggttcaagcaattctcctgcctcagcctcccgaacagctggcattacaggcgcccgcccacggccagctaatttttgtattttttttttttagcagagatggtattccaccatgttggccaggctggtctcgagctcctgacctcaggtgatccaccctcctcggcctctcaaagtgctgggattacaggcgtgagccaccatgcctggccagcctttgagtcttcatttatggagactataaagtagactcaaagggagaaataaagtcatatgtaagataaaattatatgttttatagcttagggttaggtgacttgaatatgaaatatatgatctattggacagtagaaaaaagcggggagaagattgatatcaaataccaacagcagatacaactgttgctgagaatgaagttcttttggaagatgcagtgtagacaatgctatcaatgccctgtccacatttttggaccctactgttttcatggcagaggtccaccaactgccaggactgaaatcatttacctgaaggtttttctttgtgggctgagaaaactgcttggctcctgcttgaggcggttttcaggtaccaaggaatgaaccccctggcctcccatgccccagagaagtcttaaccagatgactggatgaacaccgcagctcctgcccctcttggggtaggcaattctgaggtgtgtttctgtgtctttcgtgggctctcctcccttccagtgcacttcgaccacactctccacccagtgttccctgagttgccccaataaattacttagatgcgaactcttgtctcagggccttctcctggggaacccatacttagatatgcaagttcaaaagcgatcagggccattgagaattcaaaaatgatttttggaaattgaatgtatacactattttatgggataacttcttgtactgccaggggttgcttttctctgtcttctctatgctcagtttgatggttcaagatattttcttttaaaaacgagaataagaggagtccttgaatggtgatgggtagttggtttataaaatctgtttatgttctgattttcttgttagtatttttgataaagtctcctttttttaccctatgccttgattatcatgactgatcctacttctgcagccaaacctcctgactgggacacacagctgattcattttattatttccacttgtactggattctctaatcatatcaagactggaacttcaagagacacattatcttgttagaaagaaatactgttttaattgaattacactgaaaatgtttttgctaaaaatgccattgatgatataaaatgatgttcaattagaatatttaaaattaattcatttttatcttgtatacattgatttcctttagtgtatctaatacatatcacctgaagaaagtgactcatatttaatataattttccaaaggacaaattaaatctccaggaatcattctgctattgacatcacttttttttttttaacaaagctgagatttattattgaggttactttttaacaaagctgagatttattattgaggtcttgccttaaaaaatgattcatagaaaagtccattttgagttaaatctgagtttgagtcccagatccttttttcccttctattttctggagtagggcttcttttggtcttaatttttaaaatttttattctattttagtttattgagacagagtctctctctgtcacccaggctggagtgcagtggtgtgatcttggctcgctgcagcctcaacctcccaggctcaagtgatccttcctggctcagctccccagtagctggggctacaggcctgtgccaccacacctaggtaatttttgcatcttttgtacagatggggttttaccatgtttcacaggctgatctagaactcctggacccaagggatctgcctgcctcagcctcccaacgtgctgggattacaggtgtgagccaccacgcttggctttttggtctttactttatatttgaaatttggataccaatattagtaccttcaaagaggaggtagaagttggtaacttatacttccttaaacagaaaactattggccaggtgcagtggcttatgcctgtaatcccagaactttaggaggccaaggtgggcggattacctgaggtcaggagttcgagaccaacctggccaacatggcaaaaccgagtctctacttaaaataaaaaaattagatgggcgttgtggtgagcacctgtaatcccagctactttggaggctgagacaggagaatcgcttgaaccgggaggtggaggttgcagtgagccaagattgtgccactgcactcaagcctgagtgacagaggcaagactgcgtctcacgaaaaaaaaaaaaaagaaaattatttgagccatacagaatggcgcccttttgggaagttctattgtagagaatgatagaagaaaatatactccacctccacattttaatgacagacattgagaaaatctgactcagtgttttcatactcttattataaattatgcaggaataacactgatttaagacaccgcaaaggggaaagtagaattctcagtatatctgcattacattccacaaagaaattagcattgattccatcaaaaatcttaccaataaaaataaacacttaaaatatttaagtgaatccattttcctgaggtttgaggtccagcattttaaagcattccaaatttaactgggcagccttctatctaaaaaacttttggtggcagttaatcataagaatgattttactttctatgtccactttttaatctttgaagcttaattgcttagtattatttattaagcataaaatgtaacagagatttctctgctaggattttgtctgttagagtgcaatatatttaaaatcctaactaaataaaatagttaccctgaggtgataaactgatttaaagaggctactgaaagttggagaattttgctcatggaaggataatgttggcatcattgaattcactgaatgttcactctatagagggtgctgtactccatgctttagttatacagttgagtgagccatggtttaccctccaagagcttagagtccactgagggagccaggacaaatacagatggaaatgtattaaaggccataagaagagaacaggtgcaaagctgtggaggttcaaggctgcagaaggagcatccagttgagggatcaggaaaagttatatggaggaggtggcatttgagatgaaccttgaaagactgggaggatttcagtaggtggaggcgggtgtcaggaatgttcaggcagagagagcaaaggccagaaaactgggactgtgtagatgtatttgaatgtgctgaacaagcgttttgtggttggtctgttggacatatgtggcagaggcctgggagatgaggttgggaaggtcaagcagggcacatggtggagagcgtgagttctagtgtgagttcttcgatttcttttctaacggggaatggggaggtttgagtcggtgtttggtagcactcaaagaggtagattagggaggaggaggagcagattgtcaggaaggggcacaggtagacagctgcagacagagcccagtggagaggtttcgactagtagagaaggaaaggacagcagcctgctaaactggccctgctgcatcgacccttgccccctttctacctgccttcccttcagcagccagaaatgttaaaatgccaatcctttgctcaaagctctgtggtctcccagctcattcatagaaaagtccactcctttatgacctatgatttaacccctggttacctcttcgactttatctcctttcagtcccacttgtttattgtgtgttctgcttcagccccactgggctcattgttggtcctcaaacgtgccagagagtctcaccccaggacttttacacttgccacgcttgtgctgggaatgttctctcacttccctcagtgcacttctcacgtggccccttatcagtgagcccttccttagccaccctgttaaaaatctctgacctctccttcaaggcttcttacctccatcctgcctttagtgttctccttagcacccatcactcactcacctaccatggattttacttacttatttattgtctccccaatgagaaagtaagctccatgaagacaggaatgtttttttttttttgtccattacatttcctgctaagtttacaccacctagtaggtacatagtaaatatttgatgaatgaattattgaatgagaaaaagaggtcatttctttttctttttcttttttttttgagactgtcttgctttgtctcactctgtcttgctctggagtgcagtggcgtgatctctgctcactgcaacctccgcctccaaggctcaagtgattctcctgcctcagcctcctgagtagttgggattacaggcacccacccccacacctggctaatttttgtatttttagtaaagatggggtttcaccatgttggccaggctggtcttgaactcctgacctcagatgatccattgcctcggcctcccaaaatgttgggattacaggtgtgagccactgcgcccggtgaaacaggtcatttctttagggtgtgacaactgatatgggaatgatggagagagataccagaggtgattatagggtttgaacctcagataatggggagaggaactagttgagagaagcagaaggaatagattctgaacttgagctgcctaagaacacccagaaccattgcatatgctcctttgctaggtgttttggaacaagtatagtatgaatgtgtccaggtcagtttttgacgcagcaaagagggatcactaaaagctacatgcctgggccctgtgctcttagtcttcttgcatactgcctttgctaaatagcactttaattttgtgtttgcagttttattgaaagctgctgcttgaattccccatacttgccataggatggttgctcagtgccctttatataaaacccctttctttggatcattggttctcaaacccagcctacaacagcatcaccacaaaggctccctaaaacccaggtctttaggccccagtccacagtctccgattcagtaggtctggagtgcggcctgagaatgagcattttttaacaatttcccagatgatactgaagctgttggtccaggaactgcactgtgaaaaccacagctccagaacatagttaggaaaaactttgttttccaggaagaaagtagaatgtttctgtgtttctgataatgatgattatatagctttttgctttgatggccaggaaagtcagagtcaaatctaaaacccaggaaaagtcttatggccacatttaattctttctcccggtttggatgctctgctctatttatgttttctgtgtatcgaattatttgtttctttcctgtctattattttattgtatgtatgatttctggtagtaagccacatctttagatttggacttgcagcttaggaggtgaaaggtaaatggtaacagtccaggcagagaaaccctgaaaaagaaagctctttctctatactcagcaaaataactgtggggtgactcatcaaagtagcatctccttagaaagatatgtgaacatactcatgagtgctgatttaaacaagcaaggtagtactgtggccaggagccactaatgatgtattttaggccctggcagccatgtgtacccccttgtcgtaggcaagtgtctcaggctcaatgtgctaagctgccaggtgactgtggcgtgctagtgtcatctagctcctgtcttttccaggcaagcagcaaatgccatttgctggtgtgttttggaggggagggaggacttagagtaccttcatggggccttatgattgggaaacccgtgggatcatttctttcaaagaaaatgagcaggaaatgagggcacataggtcctgtgttggccatgttgcatatgataagcagtcttggttttgcttttacagaaaaccctgactaaaaatagtttgattcttctggataacagcatggaaaagttgtatctgccaaatgctcaagaacatacaggatcatgcaagattcacaggccatagaagttactaaggttttcactgcaggacgatcatattttttcaccagctttttgacgcaccagaaggctttaaagaataaaaatgacaggaactgcaagattagagataatggaacatttaaatacagtcatcccttggtatccacgggggatgggttccagaactccttggtggataccaaaatccacgatgctcaagtctctgatataaaaatggtgcagtatttgcatataagctacgcacatcctctggtatactttaaatcatctcttgttacttataatacctaatacaatgttaatgctatgtaaatagttgttatatggtcttgattagggaataaggataataaaaaagtctgatgtgttcaatacagatgcacccattcattttttttttctgagtattttcaatctgtggttggttgaatccatggatgcagaatccatggatgcagaatccatggatatagaggaccaactgcactttaagtactcataaaagaagaggatcaagaagtttcatgagatgttaaaggctgttcaataatttgcacccatgggattttaacttatagagatgtctgagtgatgatatgacgaggttaataccgctggtagaataaattacttacacttcctaagagaagggggcatgccttgccatgcagggccacagggggagcatcaggttggtcaggaggcagaatcggagcaaggccagagtctaggccacagcctttgttgggatatccttgggaaagagcttaggattggctagtttgaataatgtccacaggctgtgggctataaggatgatctccagttgtctggtacctgaccctgggtgatttaggacaggtgaagtgtgtgtgagttagataaggaggtggttggggctaccaacttgggattggttggtttgcttatgaaaggtatgctcgcagtggcagctgagcccaatgctatctctaagaagtggctatagtcctgggagggcagtctctcgctggctggcaagctttttaagaagtcaaagcattataaaatatagaaatttataaacatgattaatatggaagcttatgtgttctagctggagtatctgctcactggcctccttcggccataattatcacgtggtgttccctctgcctttctttattacaccacttttcatcctcccccttgaggaggcctttcctatgccctcaaggcaaaggccttggtactgcccatgtgctttgcaaagcaccctgtattttggcagtatcacattattttaaaatttatcaataaaaatccccatcttttatataactatgaccttctactctggttgctttcatcttcactcttggtctctgtgcccaatgtgaattttatgccttgtttgactttagtccctttaagctgcctttgtctgcttgttcgatcactcttctctcaaaatgtacttttatataagaaatgggtgttatttaagacttttaggaaaggactagatgggtttccaaatggagcccaataatttaagtattgagataaatgcctggcaatatctatcctaaggaaatttctttttttatttttctttctttttcacaaatatctttattggacaatcactacaggactaagaactcaggatgcatacatgaaaagttacagaccttgccctcaaagggaggcagaaaagaaagtagacacaatattaatatgttaagtcctaaaatggagatatgcacattctaagaaggtggaaggaagaggaggaaggaatccatgttggctgcctgagtcagggaggacgttcagggttgacacatttctgcatccttttaaaattgcagcttttaaaacaagatcctaaaagtaatacatgttcatgacagaaaatttagagaataaaataaaagtgaattccaatcccatttctgaaaataaaatgcttaactttttttaatagtaagaaagtatttatattttgaaactagatagatgtggtggttgcacaacatcgtgactgtactaaattccactaacatttttactttaaaatagttaattttatattctgtgaattttggcacaataaattatttttttaaaagggtatgtattttagtggaatttaaacattaggaaaataaactgcctgggctactaaattttagataaatgttagtatgtgtggatatatccatgtcaaaaattatgaaaagcattaagaggggccagtatgtttgtttggtatttaatactcataatttatacctgggtagaaatgtacattttggggtaataaaatttagtcaactgcttcatagtaatactaacttatctattttgtataataataaaacaagcagtagtcctcatcccacccccagtttaaattttaaaaaaagatgtaaaaggaacaaaattaatagcttatgtttacttttagaagggctctttagaagaacataaaagaaatgttggtgtggatgcacaatgtcggtgggtaaaaacaaacacacaaacaacacatcctggggaaggaattttcttgcaaccagaaaaaaaaactaatcagaaaattaatgaaggttaaaaaagatggtgaaaaactaattagcacacagaaattagtattcctaattatgattttgaatcttgaagaaaatgtcagattatgctatgcattcactagtattaccagttaatacaacaaaaatatttaaagctttgttgcttaaagaggcaatcactcagaaatctgaaaaattaagcatatctctttcccagatatgctggataaaggacaatattgtatattttctgtttctcctgttagtattttaattcttctttaatggacattttagtttataatcttatctgatgccattaaggattctttagcattaaagaaccatacttttaaaaggagcataattttctattttcagtgagttcaccactgtggaccacctttcatcttatgacttatgctttcttagctcttaacctgctccccaggaggaaattatgtctctttggaatggactccattttttcacaagtatatggctattgctttagtacaaattattgcagtgatataataaagaatgttaataaatgcattccaagtatattttttgagtgcctcctataggccagatgaatgctgggagctgaagatgtacagataccccaaggtcctgcagtcatagcttttatagtctcctgaaaggaacagacaggtaaacacatgcagctacctaagaattgatgactagagctatggaccaagtacatgggagcacagagagggagccccctagactgtctagagaagctgtggatgcttcctacaggggcagatgccaatcctgaaagttgatggatgagtttgacatttgccaaggagataggtggggaataccacaaatagtacagagatgaagaagaccatgccatggatgaagcttggggcagggcaaccgtaggactacagagtggaagggcaggcagcagcccgctctcacaggcctggcgcactcagtggtgttcatggtagctgggccgccttcttatgcttcttatgcttggtcaatccctttgttggcatacatttttcaaatatatcattaaaacaaagtttgtttcagtaatctaacacaacagcaaaaagacatgatatagatcctttcaggttgtaaagagcagaagccagttccagccacctgagatactggggttctggtgcaaggctccaggggagaggagaagccccagcagctgggcccctggcagatagggatgtgcccattgccattgagctccacagtcactctgcagactccactgtggctccaggttcagtttttcttacttttgtctctcactcaaatcttcatactccctgcctaattagccctttatagtctccaatgcaaacactccaagggaaacaaagccaaggggtttttggccagtctttgctcacatagggtgccttaggcttctggtggctgttgggttgcctgtagatagcacctctgagtcccgcctccttccctggtctaatcagctcatttggggatatcaggtcctatggtaaaaaccttgcagcttctgtataaggagccacagaggatgggtcttgcagtgtgacagggacttgcagagccctctccagcctgggatatatttcttatcaaactaaataaacttccaggaagttcgtctctctgcccacttgaaaagatgattgcacctttcaggttcaccgaagttggtgcttgtttaagctttgctcatccaaataaagaccttttgtagtactagttactcgggaggctgatgtgggaggattgcttgagccctgagtttgaggttgcagtgagctatgatcacttcattgcatactggtctgggcaaaagagggagaccctatctaaaacaaacaaacaaacaaacaaaaataaagaccttcatcaaatacagactttaaattatgacttatttaacaaatgagcataaaatattcacacatgctggaacccacttggctaatggtcaaaaaattacaaacatatcaataccttctgccttatatcatgctgtgatcagtaggtttggagaataaattacggcctctgccctcagtgagactgatccagtctctcctaaacaccatcccttatcagcttccataagaatctggtcacagccaagcacagtggctcacgcctgtaatcccagcactttgggaggccgaggcgggcagatcacaaggtcaggagatcgagaccatcctggctaacatggtgaaactccgtctctactaaaaatataaaacattagccaggcatggtggcaagtgtctgtaatcccagctacttgggaggctgaggcaggagaatcacttgaaccctgggggcagaggttacagtcagctgagatcacgccactgcactccagcctgggcaacagagcgagactcagtctcaaaaaaaaaaaaaaaaaaaaaaaagaatccactcacaccacctatctcagattttctgaattttgaccaaaggctttggaggcccctgggtgcaccagatttattgcagcatagctctgttgtgattggagtacaatttaacaccaggtccgtgtgcacgtgatgatggggccgcctatactgtcatcgatatgcacctggaaggagcaaatgatctgccaatgctattaacacttcttttaaaagtgatttcagagtatagaccaccttaaattataacctcttgaattttggtgctttgtgttgaattttattcctactttactactgtttaaggcatctcctggttttagtgccagcctgaatttgtaagatttcctagcattaaatgatcaaaaattgataatcactgtcattatttcatcatctctccttcatcatgctttttactgcatctttggttttacaatgacacagttataaatgacaccaagaaactgatctaaaatatattctgtagcataaaaattaagtatttggttgcaaatttaggaaggtttaacaacttctttgctaacttagtcttctaaattttgtgtttttgaaataattttgaatttacatgaaagctatagaaatagcacagggcaccagtgtaccctacatcctgattccccaattgttaacatttctgagaaattgagggtgtggtactctactgtccctaatacttcagtgtatgtttcctaagtacaagaacactctcctatataaccacaggacagccataagaatcaggcaattcacattgatctggtgctatcatctaaaccataggccccagtcaaattttgctgattatcccaataatgcccatgatgtccaagattcaatccaggatcacatgcgtttagtttttgtgccctttagtctccttcaacctaaatcagttactcatccttttttgtttctcatgaccttggtcttttaaaaaaggtacaagcaagtaactttgtatatccattaactttgaatatccattaactttgaatatccttcaatttggatttggtgatatttcctgatttatgcatgtttgcaggcacaccactgaaatgatgctatgctcagtacataggagcagagacatatagtgttaatttgccctatcactaataggcttttatcactgggataagatagtatttgccaggttccttcattctaaagttaataagtataatgtattattaatcaatgagtaattaaaaagaactttgtggggaaatattttgaggctatgtaaatacatttgacacctattatttgtggcagctatgttctataaagtcactgtgaacactggattagcctggactgaacttcactcctacggagggtacagggttgggttcctattacaacataatcgtcaaccagtcaatcaatacatgacctcgctttatgtatctttctgtttaaagactccttatttaatatatagggttgattcattatcattgaacttatggtcaattgcactgtaactcatgcctgaaggaagcttatctaacatgagtattttctccgtaaggcacatcatagtcttttgcactttaggaaccctagacagcactgcagcacaagggattttaaacaatgagatcaccaacaaaaagtacaaaaatgcaaagcatgtgagacaatgtattatggaaaggacacgagtttacaatatgacagcagaaacaagaaagcagagtgtcaccttgttccacctcagctgggaatgtgtgcattggacgactcaaatttttctctggtctgcatgtgactgtgaaagtgctgtgagtgttaatttttggggttacaaataaattttagcaagtagatgtctttggaaatatggaatctgtgaataataaaaaccgactatatctcattcctattagatttttgcttactggtttagcatctacagaggtcaaattgtcccagattgggctattgagaatccttcaagctgtcttctgtgtccttatgacatgtcctcaccattccatgagcacatttttgctttcttgttcaacaagattttctaggcttatcttgtattatctctgctccagttgtaaagttagacatttttccagggaactcttgttccttttattagaagatggtttttagaaatcaagaattggttgctaggtggatgcattcctaccagggtgtcattacttctaagccttgtgagcagacggagaaggacctatatttatacccacatacaaacacacacacagtctatcatccatgtatctatcttcttctaatctatttatctatctgtctatctgaaccatgaattcataccagtacctccagttccaatctgatgtagaacgatccccctttccatatttgtaactctcttctttggcagttagaaaactgatttccattattttcaatgtatttataactttctaagtctcctttgatgtaaaaaatcacccagtcccaccaaccaaaggtacaaccctgtatactgttctcccaccccaactcctggagggctgtaggctgaaagctcagccccagtaaaggagaatgagaaaggtagaagaaaggaacttagagtcgttgaaggtctgaacttctgctaattcttcttagataacagcagacttttttaataaaagaagagagaaccatcatgcatgtttttagttacccttgaaattagaaggctattttatcatgccaaatggctatagaagaaaaacccgttcaatataaccagtatttcttaaaacagtcatgtgatagtatgttactttcttatgttaaaaatttattttatatttctcccagatgttttagagtcaacacattggcttttaatatgctgctaaacttaatttgaatctttaaatgttgataggtaatcttaactttctaagttctaaattttggatatgacattttaatttacagtgtttacaagaggctgtaggatgattttatgaagcactttatgtttttctctggtgtgtttatccatgtaaaaaaataaagcatgcatcttaatttttattttaaattgttaatttaaactttagaaattaaattaaaatatagaacattaaatttagtttaaattttaaaatgatgacagtgagcagtcttaactttctaagtttcaaattttggtcaacaggaggctatgaattatagctttaatacaaattctaggctaattttaatgaaatgactttattatgttgaaagagataaccgttctgagatgactgtattgccaaaaataatacagcttaccttttctatgaagatacataaagattacataaatgtacattaattcagagaacacaaaaccttaatagtctggtgttatatatttttcccagatgtttaagagttaacacataggcttttaatatactgctaagcttaatttgaatctttaaatgtggataggtaatcttaactttctaagttctaaattttggatatgacgttttaatttacagtgtttacaagaggctgtaggatgagtatgattgagaagtatatatttgaccatataaaatacattgttttggtttgtttgatttttaattaaatagaattacacacatatatgtacatctatttttgcagcttgctttacacattaatacaaatatttcttggagttcttttatgccagtacatacagctctattttgtttttaactactgtctagttttccattatatggctgtgccatcatttatttaaacatttcccactgatggaaatgtagattcccccctcctacatttttggtattataaattatgctccaatgaaaatacttgcacatataccttgaagcacatagatggcaggttctgtgaaataaatgcctagactcaagggtgaggctttactttctttcttggaggcagctcagcaggtgctaaacccccacctttcagctctccttcctctttggagatctttgttccccaattcaagcacctcagagtgtctgacctgatggcctcattcttttagctttttaaactgtgactatttcctgtttcataatgagccttgacaatcagaagtataacatcatgtagatgcccacagaagcagaatagctacataataatattacttgggagaagtggaaattgtaatttaaggctgcattgcaggcactttacacatctagtggactttaaggccttaacaataaatagcattgccttaattactgaagaaatgcaaataattctaacagtttttgaaacaggaactatcagttgggtactgcttataaggatatttgtgtatgggtatgtttttaggtactttacttaatttccatatcctggttgaaagttaaaaaaaaaaaacaaaagaaaatctatttaaagaggatggtttctaatcgtcatcagatctttctatttttattccttggtggcaaatgttgctgaatggctatttccagttcatttcaaaaacaattcagttttattttgttttccatccattgtttataacattcatttgtcatttttgtcattttgtagacctaccaagagcagctgtcaggatcttaagcaacatgacattcctttttgtgagtttgtcatacacagctgagagtgccattgtaactgctttcattaccttcattcccaagttcatcgagtcacagtttggtatcccagcctccaatgccagcatctacactggtaaggcactgccgctagggctgcttgaaaacatgatcattttgaccatgaaatggaatgggtaaagagaaagttcaatctaacatcgaagtgttaagctagttcattaacagctacctttccccccagattttaggaggaggaaatcctggaaagtgttctctttgattcagattgtattaccatgtgacacatttcccaactgtgttttgggaagggagagaattttgcatatttatatttctatggttctcagtttaaaaaatgaaataggcaatgacattcaaatttaaatctaaatagatctttttatgggttggcatgggttttaaagtgttaagttaaaaaaaattgataacctgaaatatagatcagtttcatggtagcaggatttccccttcagaaatgtgaacagattttatttgaattactggagatgtgtgaagttgaaaaggaaatgtatgaattttattttagatgtttgatgtctgggaaactgatttttaggagactttgatgcatatacccatagtacttagtgcttaaaatcttctttcataataaattggatgcttagaaatgtggaaacattaattctcagatattggaggaattttcagtatattatataatgtaatattgtagatattttcttagtgatatcaaagatggctgattggccatatcttcctaaaggcttaatttatttaataaggtatatttcagtagttgaagtgtatttaaatagtgtagaattatgataacttttcaagtgacttaggctcctacgttctccaattccacattcaaatccagtaaacttgaattatctgaaaatgaacaagcatcactgtagaaagagaaattgatttgaaatatctgggtaatcactttgttctttacttcatcttatacatataaagacatacaacattgggttgtgggcccaggatagcacatgtttttataaagaatacactgctgtggactattgtaattgtgacttaaaatatgtttttcttgatcttggttgcaaaaatatatgatttcctatattaaggtaaaatttccagattattttatagtttggttgtgagaaaatctaaaccttctacttgtagtttaactcttccactaaccctttgttgagcaatgatttttggacagggaaaacaaaagttgtcttgaagttagattcaaagccacacagctgttaattatagggtagtctccagcatttcccaaactaagtttcaatattcaaaggtgttagtgggaagacagttcataataaaataaatttggaacttgctgagttaaacaaagtatcgtaggattctttactgcaggccctttcatttcctttaatatgccgatatgcatcgtgaaactcccagaagacgactcagactacagccttttccaaagtcatttgaccatgaaacctgatttttttagaggcatctttttcataaacagtgttccccaggatacacatagggaagccatactgtgtgccccagttccagccagactagggagcagagctgcctagatcatcccacttctctacagatgcaccattttcaccccagggttagtgggagagtagtgcagtgctgagccgggtaggcattaatgcaccttgaatgcatatggctaaagccatctcttagttactggtagaggccaaggctagacagacaacttgtggaaaataaagggttcagctggagctggggtgtcggctacagaataaagggttcagttggagctggggtgacggctgcagacttccacagcagtgtggttgaggcagtggccactaaatgtgtcccacttggccaggaaagtgcaggattgaataaggctaactcacagtgttcatcccatgctccaatgtcagagttaaagaagcaatatctcaaaaatgcgacttccattctgattttgtcatcagcaacttttgtttgttttgatcatagccaatgcagtttatacaatgtttgctattccacttcttctgataaaaagctttttatttccaggtcacatattttttcttcctttatagataggcagcaaataataatagtcaagagatattaagattgattaagagtagaggggggcctgtcaaattgcagtaagattaaacagagatgataattatttttaaaactactcttggtttttcttttcttttttaaaaaattttaagttctgggatacatgtgcagtatgtgcaggattgttacataggtaaacgtgtgccatggtggtttgctgcacctaccaacccatcacctgggtattaagccccacatgcattagctattttccctgatgctctctttctcccctcaatcccacaacagaccccagtgtgtgttgttcccctccatgtatctatgtgttcttaccattcagctcctacttataagtgagaacatgcgagtttggttttctgttcctgtgttagtttgctgaggataatggcttcaagttccatccatgcccctgcatatgacatgattttgttccgttttatggctgcatagaattccatggtgcatatgtaccacattttctttacccagtctatcattgatgggcatttgagttgattccatgtctttgctattgtaaataatgctgcaatgaacatacgtgtgcacgcattttataatataattatttatattcctttgggtatatccccagtaatgggatcgctgggccaaatggtgtttctggttccaggtctttgaggaatcgccatactgtcttccacaatggctgaactaatttacatttgcaccaacagtgtaaaagcgttcctatttctctacagccttggcagcatctgttgtttcttgactttttaataatcgccatcctgactggcatgagatggcatctcactgtgattttgatttgcatttctctaataatcagtgatgttgagcttttttcatatgtttcttggctgcatgtatgtcttcttttgagaagtgtctgttcatgtcctttgcccacttttcaatggggttgtttgttttcttcttgtaaatttgttaaaactcctcttggttttttgaattgttatcagtttaatcattcttactctctgggcatagatttcatttttcaaagaaattttaaaatttgagctcttttgttctctgaatccctttttttaatgcatgtagactgaaatggggaattgagaaatatatctgaaaaagaatttatcatctgacaaagtttttgagttcaaattctcttttcacttaaaaaaattatttagatacataccctgaccttcactgcaatttgtttgcgttgtgttatggatagagaggaagcaccaaacacctacagaaggactgaccttctattgctcgcttgttcacattgccattgaatgccagctctgtgcacagcactgtgcctggtgtgtggctggggaaatctaaagactcacaccagggccttaagttgcttacacatctaagaggagagagaaaacttatgaaatacattagaaaaagctgtctaaataaataaacagaaaatttggatcacagagattattttcgctgatggggcagtgtggttgagtttcatttcatggacaatggcttttaactaggtttttaagggaaagtagaatctgcccatttggagtttggagaaaaggtgtttatttcctgtggaggaccagcttgagcaaaggcaaagcagcaggggtggataaagcttactctagtggcaaaggagggtggaggggagagtttatccctaggtcagaaatagagctccaaaggcaagcaggtgcagggtgggaaatctgctcagggaccttcagctccacttctctcatgctgtaatcacttgaggacacttgtgcctggcgggaggtggtgacaccaatgtctgacgagggcatcatcgcaataccagagtcaaccccacttcactcctctggtatagtgtgtttctactgaacagtggggtctgtgtcacagtgctctccctgctcatggtctttctgctgacccacttggggtcacatctatctcttgaaagtagttaaatattatgaagttggtattttggagaagcctgaaatgatgggacgaccccttgtattagtctgttctcatactgcgataaagacatatccaagactgggtaatttataaagaaaagtggtttatttgacttacagttctgcatggctggggaagcctcaggaaacttacagtcagggcgaaaggggaagaggcacgtcttacatagtggcaggtgaaagagagtgaggaagagcaggaaaaactgccttataaaaccatcacgtctcgtgagaactctcaccatcatgagactagcatgggggaaccaccaccacgatcacatcacctcccacctggcacctcccttgatacatggagattacggggattacaatttgagatgagatttgagtggggacacagggccaaaccgtatcaaccctgaaggagcagttatacagggtgcccgtggaatccattcactgccggtaactagttgcatggctttggtcaagtcactttcctccctaaatttcagctgaaactggagtttatctgtaacttgaggatagtctctcccctgtctctctctatgtcagcattgttgtgaggatcaaatgaagtagtgaatagtgatttgttttgaagcttacttaacttcaaataggtacaacaatataaatggaaaaatacaacccgatcatatcacagtaaagaaaattattatttatgatgatagcaccttacatctgaagttgtgcactttgaataggtctgagaataaaatttctgtaataataacgatgataataaaaacactgctgacatgtactgagtgtttactaagtccaaggctctacctaagcaattttatgtgggtaacatcatttaatctatgtaactaatgcctatgaagtagatattattaattatgccagttttctagatgagaaaaaaagggccagaagggtttaagtaacttgctgaaaggcaaatagtaagtgttagaactggatgctagagtcttgtactccttggagtatataaatatttctatgtgatttttttttttttagacggagtctcgctctgtcgccaggctggagtgctgtgccgtgaactcggctcactgcaacctctgcctcttgggttcaagtgattctcctccctcagcctcccaagtagctgggactacaggcatgcgccaccatgcctagctaatttttgtatttttagtagagatgggatttcaccatgttggccaggctggtctcaatctcttgaccttgtgatctgcccgcctctccctgctcatggtctttctgctgacccacttggggtcacagtgctgagattacagatgtgagccactgtactcggcctcgctatgtgatttttactgaaatattataatacgtatatgctgttgtcatcatttcgatttatttttttcactatttccaaaaagacaatattccaaaggatttaggattccacttccatccactcagccatggtccacaacgtctgttttcagagcactgtgatctttcagcattgcctttgcttgggctcttgccctttgatgtgtacaattatagagttagagctattggtttgtctttacaagggaagtagccttggaaaattccattttgtttttcactgtagaataattgagatacttacttctgcggtaaaagaattaggttggggtgtaatttttaaaattactgtaatttttattgttgtctaaataaccaaatatttgccatccatcttcagccactgaattgggatttggttgaagtgatttacagcagtgccactgaacttaaattgcagcctttgggaatcacttcatctttagatgcaagagatatatgaatgggctttgatttgtttcattcttctaagggcatcaacagcttttatataagtttatgagcagtttttaaaatttttgtactagttttgtaaatgtatacacagatttttctctttaatgttgagattaagcatttaaatacaaatctaagtgttttaggtgtagatgtccactatcactggccatttccaaggtcaggtgatgacacttgcccctgagacgtgtgctgacactactcaagcatggtggctctgagagaggagaaaggtacttgcaaaccaacattttgtagcaggtgctaaagtcttcccacttatatcattttaatcattattgagatgaatagacgctattaggaacaaaaagtgaaaattataggctctttgtcttttggggagagaggtatgtattaatatcatgctgaattacatttgtttctcttcagtgctaatgagaacttttgtaagagctcatagtggacaaaaagtcagaacactcagcttctctttatcaatcaactaatttaaggaatgtttgggtgtctaccatgtggcaggttcttagccagtgctctaatggcagttaaacagggttcaattgctctttaacaatgtttttaagactcagatgacccaaaatgataagaaacacattggcatttcttgcaggaaaggatactacatggcatcagcattaaagtaaagatgattaggttggtgcaaaagtaattgcggtttttgctgttgaaagtaatgacaaaaactgcaattactggctgggtgtggtagctcatgcctgtaatcccagcactttgggtagctgaggcaggtggatcacttgaggtcagaagtttgagactagcctggccagcatggcgaaaccccgtctctacaaaaaatacaaaaattagccaggcgtggtgacacgtgcctataatcccagctacttgggaggctgagaggcatgagaatcacttgaacctgggaggcagaggttgtagtgagccgagattgtgctactgcactccagcctgggcaatagagccagacttcatctcaaaaaaaaaaaaaattgcaattacttttgcaccaacctaatactttgcagccacaggccatctcacatgcttgaatatttttatattcaagccatctcacatgcttgaatatttttagtattttcttggccccatagattcctgctatgtaaccagtttcaacagccgagctctccaggggtcttagtgagactggttacaataaacatgaaatgagcatgtttggaaaaatgatttaatctaagattttagagaaggaagaaattacagagttcatgctcatttttgtcaataaacaatgctgacaagctggtacaaaccatcctcaaccacttaggacccatagttataaggcaacactgttcatgaacatgttttgtgccttgactaggagtcagtgccctacagatgcacgttgatgatttggcaagacagctcaggctaattccaggcctgtgtagttactcctcgcagggactcccagggctttcgcagtacataaggtggacagtgtttttctctccaggtctgttttctagtctagaaaacaataacttgaactgaaatgaactctataattcttccttccctaaaatcttagattaaataactttcccaaaaccctgtgtaccaaatacacatttattcttaccttccctatagagttatattgttttcttaaaagggactagttactaaccaattcatcactctggtatttgtagtaatgttgcatccccacaaactctggccatgtccagaatcaatattatctgttttgttttgctgtgggcagcctaatgtagtacacagacctctctgaatcccagatctgtgacttaactagatgtaggcttttagccaagttgcttacccactcagagtctcagtttctcatttgtaaaatgtgagtgatcattccccagggctactgtaaaatattaagtgagctaattagatcttaaagcatttggtatacagtagataatcaagaaaaatcagtttctcctctttttcttttatgaaactgtgctaaatttaaatttcctttaggaaatcttgttaggttttctgattttaaaacaaattgtattggtctactttacagtggtaattggaaggctttttgttaaatcccacccgcgaagagaggtaatacagtcatataaaatggtaagaggtgactattttcatcttgatcataggagtaaagtagtggaaactttctggggcgggagacagtaaggagtcttagggagggatgtccatgcttgcagcatattacgaatctctctctcacacacacacacgctctctctctctctctttgaattattccaaatcagttcgccaaatgaccagcttcttgtttggccagttcccccaatgaccgtaatttcttatatgattctttctctttatttactagttttcagagtaaaaatttatattctagcaaatttatatagtggccaataatttgttaaaagtattattaactcatttttaggtgtttgatgtgctttactccattgcagttatcttttttttttttttttttttttttttgttgggacggagtctcgctctttcgcccaggccggactgcagtggcacgatctcggctcactgcaagttccgcctcccgggttgatgccattctcctgcctcagcctcccaagtagctgggactacaggcgccctccacctcgcccggctaatgttttgtatttttagtagagacggggtttcatcatgttagccaggatggtctccatctcctgacctcgtgatccgcctgcctcggcctcccaaagtgctgggattacaggcgtgagccactgcaccgggcgcagttatcattctttttgatgctccagttgcccaatctttggccattgggagccccttaaagtcagtacctgtgtcctttggctctacctcagtagtctttgtggtttctgtcatgacaaaaggtgactcacttaccttccacatttcctgccctggacctcggatcagtcgtatatctgcaaggaatcttggtttctttgacaggaaaatggtacttggacaccatcatctggacactcgggttgcccattgctcattgctacaagatcgtcattgtttctggactttttctaattaaaaaaagtcatgagattatactgatgtttgcacttcaaatgttaatatcacagttattacttaccttttctgatattatattttatctcttttgtttaatgataaaaatcttttttctaatgactttaacataattattttattcaagtgtgtgtgtgtttgtatgtatgtataataatttcaaaccaattctcagtattatttattaaccataaaccataagacatatagcacagaagttaatcgtaaaatactaaatacagctttagacttttgtagtttgttttgttcaaaggccatttcttactgcagatgtgcaaaatactgttctgaagttatctgaagtaattcttctctgtttggttatatctgatatattgtgatgtttgttttaatttgtttttggtttttaattttagaattacctttttaaaattttaaagttaaatttgtatttaaaattatataaaacatttatatggtttgaaggtcaaaactataaacaaagtacattcagagaggcctcagttccattccagtttcttccaattctcttcctctctctataggaagccatttaaaacattagtttatccttttttatttctttttaaatacataagtaaatacatgtattacgtatgcaatatatataatatatacatcggtattttacattagtgtttttcacctttctttccaaaggttggcatgctatatgccctgttctgtaccatacagtctagagaccttgctcatttctggatagctgcacggtactctattgtgtgaagtctattcagtcccctaatgatgggcgtttggttgtttccattcttctgctatgacatgatagtgataggtataagtcacttcatactaaataacccatttttctaatacattatacttgttccttttaaactatctgattgcccagcatgtagtttgcgtttgcgctggcagagaagctgattccagaaagggaaaagagactgagagactgtgaatatttttgtcacataatactcaggcctcatccttcccacgctctttcctgcccaagatttagcatttaccctcagattcttataaagatcaaaagaatgaatctttgtgaaaatactttaaaaagcctatacagcttttgggaatccaaagcaaattgacatctttccttcagtggagcctgtgctatgatggtgaaaaccggtgaactttattaggcttccactctgagccaggcatggcattagcgaggtgccttccatgcatgctttgcagtcttcaccacagtactgcagtgggagggagtcctctctccagtgaagagttgatgaaaatgaggcaggcagagcagtttttgcaagaacacacctcacaatccattataggtccatattatacagattgaactgtataatatgtaactgtataatctgtaactcagagaagctgcttacaatttggaatttttattgtgtcaattttttcttctccaactttcatgtactaggtaagacatatagcatacaagttaaaagggtcagtttaggagacagatcttgttgaaattcttactctgttttttcatccacccatccatccagccatcccttcgcccattcatccatctatccactcacccacccacccatccatgcacaactatttataaagcttttgctatgggcctggcactatgcacagggaagccatatgagaacacggaggggtcccaccttcaaggcctcacagtctagtgaaccttgtaggctgcctgtgaccctggaccaactcattaacctctatgggtagcaaaggctctgaggattaaatgagataaagtatgttgtgggcttcacacagtgcctggaaagtagctattagtaataaatgtattgcacatttattagtaataaatgagatcttccaggaagaggaatctaaggcagaagagtaaatgcaggacttatgacatgtggaaaacattcataagaaagattatctggagggaatggattttaagaggaagaagaaaaattatggctaataggaggtagaggccgggcatggtggctcatgcatgtaatcccagcactttgggaggccaaggcgggcagatcacttgtggccaggagttcgagaccagcctgaccaacatgacaaaaccccattctctactaaaagtataaaagttagctgggcatggtggcacacgcctgtaatcccagctactcaggaggctgaggtgggaggatcgcttgtacacaaaagacagaggttgcagtgagccgagatcgcaccactgcactccagcctgggcaacagagtgagactctgtccccccaaaaaaaaaaaaaaaaaaggaggtaggaaaatgaaagagaaagcaagagacttgatactgaagtgaaaggctgaggaataatctcatctgaactgaaggaggctaggagatataatatcaatgataaaaatacaattgctttaaacgtgtatcagctgaatcggtgtagggtcagggtcaaatgtttatatctctgatttatttactctgcatttatttttccaatataaatggctacttttcacaactcttagtgggaaaaaagaaattttaagtgttttaattttatatatttgggcacagtgcaggaaaatgtctgttgactaaatctttcaattaactaaaatgttttttgcttcacttacctttgatgattaatagcacagtccgtatgtctgggatttgtttcccaagcacatgtgtgcacgctcacactgaaaaacaaagacaaacatgacctacttatgtggatatattctgggctctgaggacattcacctcggtgctctccacattaccacctctatgttcacagcacggtgttctgaatagcccagatcccctcgagagccttagtcataaaaaatattatatgttgttcacagagcaggattttttgtgaatagaagtcaggttgagaaagattagagagcttttcaaaaagactgaaaatccagaggaaacaaggaagtgtcagaagcagacgtaggagcgtttctgctactgagtgcatcttatccttggttcaatcaacaaagatatgcccaatagatttgatgaaggaatgaataaaaactttcttcttcctgacccttagggtttgcatctctacaatgaggatttgaattagacaatgtttcactaaagggcaactaacaaacatcccaccatcccccacgacttacaaaatcctctgatttttatgaatagcttctttttccaggcattcaagttaatcactatcttaccactttactttggatctataccttttcctggcagttaaaatttcttctgtgtatacatacatacatacatacatacatacatacatctttattctttttctcccttggtacatgagatggaactgaggttgaattgcttcactttttgcctttctgggggtactttacagaaataaggtagctcgatgtttaaatttctgcctttgagaacccagaaacttcttactgggcatgttagcaggcccatacctgctaaaatgagtgatccctacctgctctgtactgaaccaatatggtataggagaaaggttgtgggttttggcatcggaagttctgggttcaagatctgcctctgccccttacaagctgtgtagccttgagtgagtcaactaatttggcctcagttttactggctgtgaaatgctataactgtatccattttagagggtttttgaagttttaaaaattaaaatttacttaagtgtaaagaacaacacaaatattaattattaatgagaatgaccctggcttttctccctatttatcaaatagaccatcctccatataaatgacaggagaaccaggattattattgaaagagatgagggaaggggaaaagtaagaggcagggtagataattaataaagacacaggtgtgaattcaagcatccattgcctcacagttagtggcacactgcggctagtgacaaactgttctgactcccagctcctgctgcggcctcttatttccccagagatgctttctgtttactcataaagatcacatcctgagctaatgaatatcctggcccttaaatatggccaggatagagttattaacacaaggcaggaaataccttactcttttttctaaagaatgaaacgtgcttagacattattagaagtggaagtaatgtccttttgctgaaccgtctcacaatggacctcagcaaattagctttgctgccaggctcagcttcctggtgaggcatctttccattgtccagaaggtagaacttgggtttatttggatatgttactgttagtctgattagatttcaggctaatagttaattttttcaagtcatcgtactgaaattcttctcctatctctatttgcaataaagatgaatataatttatgtttgatttttgattaaagtggttatttagaaatgtaggtgcacacttcccttattacctgtgcaagggacaatttgtgtatgctaattttatatagagtagttcagtgatattattattcagtgatacattattcagtagttcagaagatattatttagcaatatcttccttaaatttgtttgaaataggtactgtataaataccaaacccttttgaaaatgtaaaaaattgaataggtatttatatattaaatgcaaaaattgaatgcttacatattgtagtatccttttagtcaattggcatatactgctgttactaaaaagcatactaggcccggcatggtggttcacacctgtaatgccagcactttggaaggctgaggcaggcaaatcacctgaagtcaggagttcgagaccagcctggccaacatggggaaaccccatttttactaaaaatacaaaaaattagctggatatgtggtgcacacctgtagcttcagctactcagaaggctgagacaggagaatcgcttgaacccgggaggcggaggttgcagtgagccgagattgcgccattgcaccctgtcctggatgacagagtaaaactcagtctccaaaaaaaaaaaaaaaagcatactaaaattgttgttaaacgaatgagcacctatcctatttcttggggaaaaacttcaaggaaagagattttacaactctccttggcttccttttctatcagttaataaacctgttcatattttttaaagtatgaaccttttcctctcacctcaaattttttttcttttgagggatataaaggataagtgaattttgattttgagaaagatgttaacttgggatgggcatggtggctcatgtttgtaatcctagcaccttgggaggccgagactggagtatggcttgagcccaggagtttgagcctgggcaacatagtgagacctcatctctacaaaaaataaaaaaaaaaattaggtgggcatggtggcttgtgcctgtggtcccagctactcaggaggctgaggtgggaggattgcttgaacccaaaatgcagaggttgcagtaagccaagatcgcaccactgcactccagcctcggtgacagagtgagaccttgtctaaaaaaataaataaaataaaaaaagaaatgtgtttaatttgtattcaaacattcatcatgcacaacattaaaattattaacaaaataaccttatagacagaataaaaaatagttttaatgttatgcaaaacaaatacatctttacaaatacttcaatatagctgaaaataaaagctatggtcttgtgctatgcttttcatgttgtggtcaacataaaatctagattcttcagtaggtttgttttgttgtgtcttatactaacatgagtaaacgtaaaatgccaataacttgccaaagaatatatatttactatagtctcatatattgtggctaaattatgcatcaagaatagtcagtcactgcctcatctctgtatcagccaaattcattgatgcgtatgtatgttcctacatatgtatgtatatattcacacacaatacgtacacgcatacacacaaatattcacacacacacacacacacacacacacacaccatgcatgtgttaacaaatctcatcatttttgtcttgaagatctgagtttgttttaggagacagtgtaactaactgaaaaaatgagtaagagttaagagactaggtttcagttttagaaggaacaatggacctggaacttaggcaacagatttctcatgtcagacctgaaagagctctgcctttgaaatcagatttttgtcctgtctttgttttgttcgcttgtgatcttggacaaggtgtgtcattcatgtatcttagtttccttatacaaaaaatgggaataaataataatccataagattaaataatattaagtgtaagtacttcaagacttgaagtactccacatatttattatgattattacattgtcatttcattttctcagtctgttttcttatctgtataaggagataatacctgtttatagagctgttgtattgatcaattaaataattgatgtgaatgtgctttgaaaaagtcataagggcttatttccctccatgagtttaggttgttgttggtaatcttggttaaagttgaagtcagctcactctaacataaacgcatttattattttattttatttatttgtttgtttttttgagacggagtctttgctctgtcacccaggctgcagagcagtggtagatctcagctcactgcaacctccgcctcctggtctcaggcgattctcctgtctcagcctcccaagtagctgggactataggtatatgccaccatgcctggctagtttttgtagttttagtacagatgaggttttgctatgttggctaggctggtcttcaactcctgacctgaggtgatctgcccgcctcagcctcccaaagttctgggattacaggcataagctatcgtgcctggcttataaatacatttcatcttttaatcatagcacttatttttttggtgtgtacctcaggatcgaagacaataagggggtaaaccctttgaaaggaattttgagtttcctgctgttttaggtggaaaattagtctaaaatatcttcctttctgaaataaataggatttgaaagaaatgatcctgaagtaagtttctataaataaaaacatttttttcttcatttttagaataaaactgagcacctgctccttcaaaaatgaagtggcttaaatgactgaaaagatctcacaaagaaaataacaaacatttgtaatttaagtgtatgtttatgggagcactagcctcatataaatctagaaaaagcattggatttagaatcagataacagtctaggccttgctctggcattaattagccaatgattcgaggtgaatcactcatctttccagagtctcacttttattttatatctataacacgaggtagttaaatacatgatctctgggctcttgtgttaatttaggattatatactttttgagaatatcagagactcaaaggaacagaggcttgaacaaaagagatcattatttctctgtcacataaaattctggacataactcagggctggtatagggactgtaatcacccacagtgcttccaatttcttctccatcacagactcctgtcctcatagtccaaagtggcagtccagttattatgtctgcatttcaagtagcaaaatggaaggaggaaggaggaagagcatggatgtactacttttgcttacatcacattggccaggacttgccacatggccacacctagttgcaagggaggctgggaaatgtagtctattccaagcagccataagtcaagctgttactctagaatagggatcttgggccaaagttagcctgcttcctgtttttgtaaataaaactttattggaacccaatcacacccatttgtttacacatgtccattacactacaacaacagaggtgactagtgtaatagacactgtctggctcacaaattagaaaatatttactatctagcccttaatagaaaaacttgtcaactcttgctttaggaaaaaaaagagtagtcattggagagtaagtagcaatctctgctctagcgcccttccaaattctatgattttgtgataacacacaaacaaataaaaagcccaaacactttatttcatgaggtagtaatatattttaaaatgttagtaaatactaaaacatgacgttttctcttgttccaatgggttgaaacttgagttgtgcctattaaattgtcctgtttttgttctgtccacttcctgattttatatggccactctcagttcccatctaattatctaagatgttagctactctcctgcaactttgagtacagaaatattaacactttatttggcatgtgccttgcatagtcttcattttggtgaaaataaaaatgtgaaaagattcagggctacctttggtcctggtgaagacttcctagtataatatctggggtcgttggtgaaccaggaaccatcacgccattaaagaagcccgtggttgtcagtgggaggtacattacattcgcacttgctacattgtattttcttcctttgctggttcacatgtatctttggggttaaattttaaatatttattgcatttacttcttatagcttttcaagttatattgttgtcttccaaagagaagttttatctgaaaatatgtgattttgttattaaaaaccaagaataaataaggtctgagcaataaggggagaagattagatgatttgctgaaagatttagagatgggtctaataaaatttaaatttttgtaggcacacaggaaccatgtcatctgtttcctttctagtaatttctacccaattgttgcgggaaattaaggaattggagagactgaacggagtgcaagaaagtgtttatttaatgtgtacaccggctcagcggacatgtgtcctgagagtctgagcctagaacaaataaaacgagtttaagcactttgaggcgggcactacgtgaagcaggaagcaggcttacagaagcgagaacaaaggctgctgtgacacttttgcaacatgtcttacatgtctgggaaaacttggtttgcaggttatgcgtctctgtcttgtgatcttgcagctgtgcagggaagaaacgaacaggagtttacagagcctacaaaatatgaggagggtagatatggttaatgtttcttgggagagacagttaatattctcttccaattttaacttcgggggggctacttaaattctttttagccttggttaatacagcaattcattctatgagctattgttatttgtcttactattactttaatctttactattattacttatgctattattctgttattttcttaacttcctacttcacaatgactagtttctataaggttgattaattaatggatttttgaaacctaagttctcatagacagtagggttgatgttctccacagatgctccgaccattagattcctagagtatgtttgcgcttgtaaaacttattttgtggatttcattatctggtggaattgtgcatgtcttttgaaacaaacaaacaaaatcttcaggttaaaagtgcagtatttagcatactggttaagattttcaacccgtctgtcactgtcttgtccaaagtggttatttttttctggcttaagctatcttattcagagagcaaggtgaactgattaatttttgaagtttcttcttgttacaaaatgttttgatttttattatcctggactcctggtaaactttctttactgaatagatggggacagtgtacaactggagtatcatttaatccccctaatgctgtgttcacgttgctccttcaggtttttgctcaaatggccccttgtcaatgagactttatccaggatccctcagttaaaaatggaactcctctccctactcctcattttcctttctccgctgagcatttttctctgtagtattttttaccttctaacattctgtacaatttgcttaattattggtttgtctgtttcccacgttagattgtaaactcaatctgggcaggaattttagttacttttattccctacatgtctccagagtttagaacaggccttggcacagagtggatgctcaataatgttttccgttaaattaaatatatactttaaaaattacatatttttgtaagttttctgaaagttgttttaaaaaacatgtttgtcaataacccaaaaatgaatttatgaattttagctcaactaccatttaagtaattgaagattaaaaacacaatgtgataaggggcatctatggaaaacccacagctaacatcatacttaatggtgacagactggattgtttctccctaagatcagaacaaggaaaggatgtctgctcttgctacttttattctttgttacactggagattatgcccagggaagttaaggaagaaaatgaaataaaaggcattcagataggaaaggaggaagtaaagctatttatatttacagattatgtgatcttctatggagaaaatcttaaggaatcaattataaaaactattagaactaataaatatgttcaacaaggttgcaagatcttacaagatcaatatacaaaaatctattgtatttctatacactagcaatgaatcaaaaatcaaattaaggaaacaatttcatttacattagcatcaaaagaatgagttatttaggagcagatttaacaaaagaaatgtaaaacttatattctgaaaaccacaaaacattgcttaaaagtaaaagaaaatgttggtcacaagacacaaaatttcagttatgtaggaggaataaattcaaaagatctactgtacaacatggtgactatagttaataacaatgcagtgcattcctgaaaattaagagtagattttgtgtgttctcactacaaaaaagataagtatgtgaagttatgtatattttaattagctcaatgtagctgtccacaatgtatcctcatttcaaaatgacatgctgtacctgataaatgtatacagtttttatttatcaattaaaaaattaaatgttaaaaaattaaagaaaatgtaaataaatgaaaagacattgcatgttcatggattggaagacttaatattattaggatgtcaatatttcctaaattgatctatctgcagattcaatacaatcctcatcaaaattccaactggcttctttgcaaaaattggcaagctgcttctaaaattcagatagaaatgtaaggtactgagtatagccaaaacaatcttgacaaagaacaaagttggaggactcataattcctaatttcaaaacttactgaaaagtaacagtaatcaagacagtgtggtgtgggattaaagcagacaaaaacatcagtaaaatagggtagagaccccagaaataaccttatatatttattgtcaactgatttttgacaagagtgccaaggctattcaatgaggaacaaatagtattttcaacaaatggtgctgggacaactgaatagccgcatgcaaaagaatgaagttggaccccctacctcataccacatacaaaaagcaactgaaaataaatcgaaagccttaatgtaagagcttaaattataatactctcagaaataaacataggcataactctttgtgaccttgtattagacaacataaccaaagaaaaaatagatgagttggagttcgtcaaaatgtaaaactattgttcatcaaaggacaccatcaaaaaagtaaaaatgggccaggcatggtggctcatatctgtaattccaacattgggaggccaagacaggagggttgcttgagcccaggagtttgagagcagcctgggcaacacagggatacctcatctccataaaaaatacaaaaattagctgggggtggtggcgtgtgcctgtagtcccagctatttgggaggctgaggagggagaattgcttggacctgggagattgcgactacagtgagccatggctgtgccactgtactccagcctgggtgacagagcaaggccctgtcttaaaaaaaaaaaaaaaggaaaaacacagcttgcagaatgggagaaaatatttgcaaatcatatatctgctaaggcagttatatctagaacacataaagaactcttacaactcaataataaaaagaaaaataagccaattaaaatgggcaaagtatctaagtagacatttctccaaaaaagatgtaccaatgtccaacaataagcacatggaaagatgctcaaccttgttagttatcacggatatgcaaatcaaaaccacaatgaggtaccacctcacactcagatggctaaaatcaactattatctgtgataataacaagagttggtgaagatgtgtagaaattggaatccttacactgctgctgagaatgtgaaatggtgcagccactttggaaaacagtttggtacttcctcaaacacagagttaacatatgatccagtaattccatttctaggcatgtatccaagagaaacaaaaacatatgctcacacaaaacttgtacatgaatgttcatagcagcattattcataataaccaaaaagtagaaacaacccaaatgtccatccaccaatgcatgggtaaatattattaataaaatgtgatctagaaatgcaatgaaatgttatttggtcataaataggaatgaagaactcacacatgctttaacacagaggaaccttgaaaacatactaagtgacagaagccaggcacacatattgtatgactccatttatatgaaaggtctcaaacaggcacacttatggaggtagaaattaggtggtgattgtctcgggctggagcagtgcggggcaagggagggctgggtgtgatagctaatgggtgtggtgtttctttttagggcgatgaaaatgttctaaaattttagtgatgattgcatgtttctgtgaatatactaaaaacattaaactgtacactttaagtaggcaaattgtgtagtatgtgaattatagctcagagaagctgtcaattaaaaaaaagaaacacaatatgtctaattagtgatgtgactatatttatgaaatgtctgctctggtcttccctattcactcggcagaattaatatggtttctcaagagcaaaatttccacctggccttagtggggcaagggcactctaataggtatagttcagatgtgcagacttttgtctcaattttttttccatatacagagtttgaaaaatctgcttacttctcctaggggaagggtagctttgtcagggttttgcagttctgctattagtgggcgtcatgacgatgaactgtctcgatggaaaagctccgaggactgctggatttggacaacaatggacagaggagaagttgaaagttgctgacagaaaatggatcttgcccagaggacctccaaagagggttttgtacttggcatgggccacatctgtgggctttacttgtatgaatggaaacccagtacagaaaattgataccaacgtcgtttgaggcttattttgatagctgaaaaagttaataaggtgctcttattctcctgtgaaatttcctctgcaaaggctccctacccacctttccagtagtttgcttagcggttttcaccttcagtttcccagcactagggaaaacggaagtaaatactgtgatttttgcatttcatcgtttcaagtggtttttgccctctgtgggtttatcgcgtggatgcagaaaattcttttaggtttgtaagccatcaaagatgaaatattaatttgatttgatttttgaatccctttcataaaacagctcagcattctcttttatgcattatttcagccagagctttacagaaacctgaaatgaaaagcatggttgttttcactgttgaatgttcctttttattacctttccttcagtgatccccagaccttgaatcctgagattggggttctcatatttctctcctactgcacagtgtctccctgtgttggtaaagagttgaagaaagtgttattatgagtgaatgagatccgtctggcctaagaggagttaaatatgggctttatataaatatctccctgttgaagtcattgaggctaaggtttttagaagtgtgtaattcctttgaaagcctttactaaaaatttcagcaaggctacgctagaaattcaaggacattctcttttggttagctgtaagtggtcccatgggagccacactatgattgtcacggggaacctgacagaggaaactgaggctgatgaagtctacttctgtctcctctaactgaagttatagaggggcaaaacttgagacagctggggtgcagcagctttgagccaggcgagctatccccccagcttatctgcctcaagagaactcctaaaagaacttactgtaagttcttctactctgcctaaaggcttcttcaggtactggcagctttgactgcaacaaatgctcaacgcatgcaggctgcctttcctaatcctaagtccaaatagggatttgctacccctcctttaagttttggcttgaagctatgctgtgaaatattatggctttagagaaaaagtttgttctctgccttaaacagccactgagttcaaagaaaaaggtaccttaaattaattctaatgatacatcttgttcattgtttatgaagggattgctgaaattttttacaacagtaagattgagatatatgaaagagaaagagatatactgtgcttttaaactttgtggagtcatttatagtttgtgagaatgtatacttatcgcgctgtctcttctcagatcagttaaaatttgctagcttcaaggtttgggttttttaaataatctttttagtagtttgcttctgacagtagttgatacttatttcctacaagaaaatgtttgcaagagaaaatggaagctcaaaagggtaaaattatttattctgagcaagaggaaaagatgtcttttgaatcatcgggttagaagcttaggctttagaaaagtgaaataaccttgagtcagtttccttgctctagaactctttaggtgtttcttcctctgtgatgtggagagaatgctgtattccttccaatctgtcacacttttgctggcaagatgcaccatgattttgagttattatgaaagaaaaatgcttctaattagattatgacataaggcttgcatactattgattgtaagacacactttgggttcagagcataaaaatctgtaacatttgagaattaaatgagatactgtatttagatcagttatcacagtacctggcatgtaatcaacatctgtgtgtgtatgcagttgtttgtgggtgtgtgggtgtgcacttgcacacacacaaaaaagggaggagggagggagagagagagagaatgaatgagtgaataaatggtactttcttcttttctaggtactcattctgctttcttgtccgtcccatgtgcccagccaggcaacagcagaatccacatgtcatgatggcttacaatgatattccttaattattgatagtctcatgtttgcaagccatttattttcaacagaacttaagaaaactttggacatggaaaacacagaaagggcagtgaaactagagcaaagaaatgacaatgtctaagattctaagagcctgtctttattaatttaagtcaccatggttggatattctgtaccactgtaatttcacaacagataagaggtttcagagactgatatcgtactctgcatttcctttggtggcttggcagtttaagcttttgctaataatgttcaattcagaatcttggtaaaagtgagatttttcaggcaccatctagatatttagtgcttatcagttttaaactgattttagcaatttattttaacctcaaattagatcttagattatctatttgtaaaatgggatacaacctagttccaggaataattgaaaatggaaattaatgagcaaatcacttaaagattttatataataaattcaaagttatataagattttatataataagttcaaaatgaatgtttgttctttcatccaaacacacactaggcgttggtcagtgctaaataaataggaggatactgaaaatatagacaagaaccttaaagaaagataacagaaagatagagaataaacacaataggagtgacaggtgtgatgagaggggctagcgctgggtaccataaaagcacattgttgttgtcttaacaatagcaacaatagcacaattgaagctccctgaacctataatacattcttgataatgaatgggttgcctaattttgttctctcctttggttcaggttttcctgtgctccaaatcatgctttaagctcccgtatattttctgtgtctatttacaatacaaattggcaaaaattggagcgaaagaggaaaaattcagtcattagcttttatatttggtaattaaataaatattaatttttcataaagaccctttggctccatgcagccacaaaattggggtccagaataaaaacgtcaaaatcgaatgttgtggcataatagtgcttgacagagaaagaaagaaagtaggacaattaatgtctatttgcttggataaatgactagataaaagatttccagctggaaagcagcaggatattcccagaccttttatgagcaaagcagaatcttctgcattgtcagcacttaatgttgcagtgagttctttagattcagataaaagacatgctgctaaatatctaagagttttatgtgttaagaacacatagtaagtaaatatcaaaggtttgtatatttaaagaacacatagaggtttatgttgggccactaatagattgcttaaattcaattctatagattaaatagcatataggaatttgcctaattataattccaatatatatgtgcaaatttaaactcataatattaggcagataatgaaattcatgcttgttaaaatgatgatgatgatggccagcatttattgagtgtatgctgttggtcagacactgttcgaagcctttcacaggtcttaattcatttaatcctaacaatcctatgaagaatatactattataatccacatttcagagaggagaaaatccgaggcctggaaatgttcagtaatttgcctgaagacatgcagcttgtaagtggctgagctgagatttgaacttaggggatctggctacatagcccagactcttacctggatctgcctcttgaacatatggaattgcgttgggttctctcctctacggctggcacctcgggcctcgggtgcctgggcttggtgcatcttcccacgctctgccccccttgccctccccaccgaacatatggaagtgtccttgggtatccatccattgatggccttttccccacctgcttttctcctgcgctccccaggtcttggccattagagggcgctggagcaggaactcgggggtccctccgaggctgggaacgcggcagggtcggggcagaggcgcagagaggtgaggtgcgcagtggtgagaggcgcaacggagcggcgagctgactctttgggacctggggacagagggaagggaaagagggcaccagccagggacgtgaatttgagctcagagagggctagcggcaggaccgtaacttctgccgggagaacccatcttttctatttatcttttccacccccaatagggagtgggcaggcggggaggcctggatggcgcgtggtggtgggtggagaaactgactcgcagccgctccataagctcacccggaactactagagctgctgtacctggagccaggggctttgagtgggggggacagtatgaaggctctgaactgtccgaccccatccctgctgctcgtcccaagacgcgtataattccccaaagcaaacttcggatctttctctgatcggagatccaagcaatgtccatattcgcgtaaatgagtggtcagacctttctgttttgatagtgcagcgagatacagatgatgggggcgccgaagaacattttcatgggtcttcactctgtttggtgtgccctcatatttactgatgacacgtgttctatttttgagagcctaatgctaattaggatgcataatcaaataaattatgctgctgtttaattatgactcagctaccagcacggagatttgttatcctgaggctgtagtacagtatccgcggctccataattgcttagttgaaattgaaattttatgaataaaacgttttcattctaaaggtaaattaatcacattgatagcatgtatacgttttcttggtgaggagggtactttattctccagctcatctcaccctagagctctgggtgagattccagggacctattgggtgtaagaggtcgctgtgataattagggcccagcttggggctgggaacagaaaatgtcagtttctatccaaacttccctttttgtgctgtgcactatagagcaggccacttccctgagccttcagtctcctcatctgtaaaagggccattgccggtcgggcgcggtggctcactcctgtaatcccagcactttggaaggacgaggtgggtggatcacctgaggtcaggagttcgagaacagcctgggcaatatggtgaaacgccatctctactaaaaatacaaaaattagccggtcgtggttgccagcgcctgcaatcctagctgcttgagaggctgaggtaggggaatcacttgaacctgggaggcggaggtttctgtgagccgagctcacaccactgcactctagcctgggcgacaagagtgaaactctgtctaaaaaaaaaaaaaaaaagctgttgccgatttcacaggactctggtgaggattacaggatgaacactagctaccaggcaaaactgactttaagttaatctcagtcttcctctgcttctctttgtgggttgttgaacatgccggagcatgcaaccgtgcaagtgaatgcagctgcaagcttctggtgtccaatattgtctggacccatattaccctctattacatattcttagtagtgccgacttcactttcccatcacggtttttccaacccttggccacaattaaaattctcaatatctcttccttctaagaggtggttttgttttcaattatacagaaaagaaaccaacaaaaatcaaaggtataaaaaatgaatctacagcatgttatgaattctcggaggaaaaacgtctgcaatgaaatatgccagaatgcaatcagtgtatatttgttccttcctacttttctgttttccttcctacttttctgtgtttttcaactgttttgttacaatatgtattacattatgtttacagaataatggaaaaataaaacagaaaaactaacattgtaaagctactactcacccacggatttatcctctgttctagcccagagaaaggagtttctctccccctattcagggctaagttgattatctgtgctattaattctatgttatcctgacttctcaaggatcttgcattgtcattagctgaaatttcccctccacattcaaccattcattccctttttagtttattttcctcagtatataaatgtgtttaagtcctctctgcatcctagcaaacagataaaaccctccaaacctcaaccctgccttgttcccagtctaattctagacccatatcccttcttccttttatatgcaaagttctagaaagagctgactggattctcaaactctagggactcatgactgactactcaacccatcgcagtctggtttctacctgcatgacactcttaaaattgctcttgtcagaggtccagtgacacattgtctcacttcagtctttcttactggacttctctaaggcacttgatactgttgtctattttctccttgaaactctctccttggtttcttggttttcttctttttttttgagatggagtctcactctgtcacccaggctggagtgcagtgatgcagtctcagctcactgcaacctctgccttttgggatcaagcaataattctcctgcctcagtctccggagtaactgagattacaggcatatgccaccaagccctactgatttttgtgtttttagtagtgacggggtttctccatgttgatcaggctggtctcgaactcctgacctcaaatgatctgcccgcctcggcctcccaaagtgctgggattacaggcatgagccccatgcctgtcctctctccttggttttctatggcacagttgtaatggtaataactacaatttttttttttttttgaaacagtgtcttgctcttgttacccagtctggagtgcaatggcacatcttggctcactgcaacttctgcctcctgggttcaagccattctcctgcctcagcttcccaagtagctgggattacaggcacccaacatcttgcctggctaattaataactacaatttatattatataccgaatactatatactgtatctacttatagatagtgcctgtaatcttcattctaaggctaaggtaaaaggaagacatctccatgacgaggcaaagaagtctgagttagaaagtttaggaagcctgcatgattacatggctacaaaagatggagtgaggatttgaactccagtctttctgaatccaaagcccaagtttttcctgcttccgacatttttgtttcccacatttcctctggcctctgtggctgttcattttcaacttgttctgtggactcacctttttatgataccccattaacattggcactcatccgaatgttgtagttttggcccttttgttttactctgcaccgtcttgttggaacatctcatttatgccatgaattcatctcctggctataaatcccccagccagctctttgttgatcttgcagcccacagacacaactgggtggggcatttcacctgattgttcctcaggcccttcacaatcaacaagtctacaatgggggccattgagctgctccgcacacacatttcttcctcatgttccagatttcttccttcatctggtgtcatgcagtcatccttcctctctccctgtccttatctaatttattgggccatctttgtggggccctactgtggctcacaaggacctttgcggtcatcctcctgaccacttctctgacttgagttttgaccacatctaagctgtcttgcatgtcatttcaagattgacctttgtaatacacagcttccatcctgtcagccgcagctcagaattcttcagcgccctccattatcagaaatacaacctgagctccttttcatggtctttcatggtctctgttttccctacctctcttctccaggtctttccacctcccagctgcttcctttccataatcaatattttggattgcattgaatcctcaatttcgttatttcatgcctctgtgcatgtattttctttgtgcagacattttctttgtgtaggatattctctgtgctggtccattgggcagattctgtctcatctattgagattcacctcaaatactgccacttgtgtaaaaccctcccagatttcatccagggaagactctctccctgcactttgtataattattttattgtattctaatttctattaagttgtttgtttctctttcagattgtaaggttcttgggggcaggcaccatgatgatttctttattttatttttttgaggtgtggagtctcactctgtcaaccaggctggagtgcagcggcacgatcttggcttactgcaacctctgcctctagggttcaatcaagcgattctcctgtctcagtctcctgagtagctgggattacaggcgcacgccaccacccctagctaatttttgaacttttaatagagacatggttttgccattttagccaggctggtctcgaactcctgacctcaactgatccgccagcctcggcctcccaaagtgctgggattacagatgtgagccactgcatctggccaatttctttatttttttacagtgaaaaataacatacccagaagtacattaaacataatttaaagataattataaagttaacactgtgtaactgtcttagttcattcaggtggctgtaacaaaattaccatagactgggtggattataaacaacagaaatttatttctcacagttctggaggttgggaagtccaacaacaaggccctggccccgtgtggtgaaggagggcccaatttctcatagaaggctgtcttctcacatgtgacctcccaccatgtaacttcacatggaaaggtgaggtagctctttcaggcctcttttataagggcatgaatcccattcattaggcctcccactcttgtgacttaatcaccttccaaaggccccacctcctaatcactctggggattaggatttcatcatgtgaaccttttggggacacaaacattcagaccacagcagtaactattacccaggtcatggcatgaagtatttttcagcaccagaggaacctcctgcatcccttccttataccatgaatccctctactatcttggcttttatgttaattactcctgggttttcttcatagttgtactacctgtttgtgcattcccagacaatgctgtttagttttataagttgttgaacttcataccaacgtagtgatgtcttgtgcattctgctgcatgtggttccttccattcatcattgtctttgtataattcttcatacgaagttgtgtgtagctatgtttctttccatttaatgagtgtatagaagcaatcctttatatagacataccatatatgatatatttattaatggacatttggtttatttccagttttttacaattataatgcttcaaatatcttgtccacttcttttggtacccatgtgcacaagtttcttcagggtatagatccaagaatggaattgattgccacagggcatgtatatcttcaactctaccagataatgccaaactgtttttcaaagtgagtgttgagatttacatcctgccaacatgttgagagttcccagtacgttacatctttaacgtgtggtattttcagactttacaattttcacaaacgtgattggtaggtagtggtatttcactgtggtttttaaattaaaaaaattttatacattacattcgtacatatttatgaggtacatgtggaatgttgtgacatgcatagaatgtgtaatgatcaaattggggtatttagggtaactgtcacctgagtatttatcatttctatgtgttaagtgcatcacctgtatttccttctgtgtaatgaggttgaccccctttcacgtgtttattgtttgtctggattttgtctttggtgaagaacttattcaagttttactcacttttgtaatggattgcttgtctttattttattgctttatgaaagtttttattgaaatctggatgtgagtccgttgttgattgtatgtgttgaaaataatattatactataaaatcacacacaatgaagatgtattgattatagtaacttttgattttttacctcagtactactgagcaagagacagaatagataagatgaataatagtgtacatgagttcaaattaatcctctccttctcttctccccaggggttattatcgtccccagtgctggtgttggtattgtcctcggaggctacattataaaaaaattgaaacttggtgccagagaatctgcaaaactagcaatgatctgcagtggtgtgtctttactatgtttttcaaccctatttattgttggatgtgaaagcattaatctagggggcataaacatcccttatacaacagggtaagtacctcttaagagccgtgtcgtgtctgcacgatggaggtgcaaagccctgtggtgtttgtgcatctgcagtcagcctcatacccctccctccaagctgttctccctgtgtgtgctctgtgtgctctgcctctccaagtggagcatgcactcctgcagggcagaagccagggtctcgtcttcctctgtgccccttctgaccccacagagggactttcatagcattttaattacatcagatgaggatgaaatgcttattggattaatgaaaattgtttggtttttattataatgttttaatagggaatatgtgtttctgtagctcaaaaacataaaattcaatgaaaatacaaggtacagtgaaacctcttgctcttacccaagtcctccatccacctagctcttcccattcctgcaagcaaagatgaaacaggtaacccctttcattcatttttttgcatatccttccaaggcttctttatttaagacattgtggatatgtattttcaattgtccctcttttgtatctaaaatagagcattcatacatgctttgctgagcttttaaaaaatggaacaatatagcttggagatctttcagtactggtagtaacaatctgaagcataactcccccttaccatgactgtattgcaggctgagcattctcttaagtgctttacatatgttaatccatgaatcctctcaataacctatcaaataggtgctgttatcatcctgagtttacagatagcaaaacggaggtactgatcacatgtaaccaatggactgctgacaaatgtttaaatggctctctaaaaaaggctcatggctggtgcagtggcccagacctgtaaccccagcacttgggggaggctgacgcaggagaataacttgagactgggagttcaagaccagcctgcgcaacatagtggtaacccatttatacaaaaagtaaaaagtaaaaaaaagccctgatttgtggcatttggcaattctgagatgtaaatacacctctgtggctgatttcatgtcaccaacttgtcgaccctgaacaccgaattgggaggaggtgctaagtcacacaccattgtataatgtttctatcatacaggtagaatagacttaaatagcctaggcaagagcattgataatagtaaaataattagaagatgatgagttttacgtatttattatccttgtctttaataccatttaattgtatgtttatatcatttaatttttaaaaatagttgtgttaaacaaacaattgacaaaatcccttagaatttcgcagtagaatcttgtcatccagggtggctgcctccagtgcaccactgtccagaacccaagacttaacctcaggcaatttggctacagtgtctgtgcccataagcactgcctttaaccactgcatagcattccattgtattccactttgtatttaacctgcccccatttggtgggcagtgggttgttcctaatctttaattgtatttatttatttatgtatttatagacatcgtctcactatgttgcccaggttggtcttgaactcccggtcacaagtgagtctcctgtctcagcctcccaagtagctgggattatgggcatatggcaccgtgcccagttaatttttagttgttaaaagcaatgctgcaataaataacttcaaggcatttatcacttctcttgtgtgctctgtatgtgcaggataaattctcagaagtgagattgaataaatagtaccaaattacctccacaggtattgtaccaatacctcaccagcaatggatatgagtgctgttttccccacaccctcaccaaaaggaggtggaaagctcttctgtgagagttatgaaaaccttaacttttatttctttttcttttctttttttcttttttcttttttttttttttgaaacagagtctctctctgtcccccaggctggagtgcaatggtgcagtcatggctcactgcagcctcaacctcccaggttccagggatcctgtatcctcagcctcccaagtagggagagtctacaggcatgcaccaccatgtctggctaattttttgtattttttgtagagacgaggtcttactttgttgcccaggctggtctcaaactcctgagctcaaatgatcctcctgcccccacttcccaaagtgctgggattacaggcatgagccactgtgcccagccaacctttacttcttaaccacatgtagttttgttaggatctgctcatttaacagagcttcattgtccaagttttggtgcttggtgccaagaaacacttctgtttccttttgtttctcagtggagttttatgttctaaaatgttccactttgcatttgaataacaaaagctttgatttcatctagccaatttagaatgtttgggagtgaggagaaggaataacaaatcagagtttatttagattacagaatactgtgccatcttttgtcctgggagttatttttctaccagaagacattggtgtgtgtgtgtgtgtgtgtgtgtaagatgtgtgtaccgggtatgtggcttcttgatagtgcctaataggatggcacaaacaataaagtctctaaaaatgaaaaagcagtatagaataagaactcaggctctggagtggaattagaatttggatcttgactctgcttggctggttgcttaatgccaaacctcaatatctacttctgtaaattggggtgatgttagcagcaatctcagaaggttgtgggcaagggttatgtgtgtaacacatgtaaagctctcagctcagtgtgaggcactgaaggctagctcttgtcattagtcatcactaataaattaagaataatttttatttctatcaaattatgttttattaaaattagagaacataaatagaattaaaaagttcataacaaaaacccagcagtcttatgactagctctgatttgcaggggcaataattttaaattctttttagctgtttcttctacaatgtgactctgtatttttcagaaatactatataaattaatcaaactaaggtattatttgtgacttcctagcttggcaaatgaggagcttcactttacctttacaaattgtggtcaaatcctttttttgtattttcatgttaaatttatgacatgtgtattgtcaatggaaagagtcgaactctgtaaaatatttgaagacatttattctgagccaaatatgaatgactatggcctgggacacagccctcaggaggtcctgagaacatgtgcccaaggtggtcggggtgcagcttggttttatacattttagggagaaatgagacttcaatcaaatacatttaagaagtacattggtttggtccagaaaggcgggacaactcgaagcaggggcctccagcttttaggtagattaaaaaatttcctggatgacaattggttgagtttatctaaagacctgggatccataggaaggaatgtctgggttaggataaaggactgtggagacccaagttcttacttgcagaggaagtcttccagtagcaggcttcagagagaatagactgtaaaatgtttcttatcagatttcaagtctgtgttgatgttaatgttggagaggtataatgagtcatgccagactccccacttcccatcctggtctgaactaatatctcaggttaaattttaaatagccctggctgagaaggaagtccattgagttggttggggggccttagaattttatttttggtttacagtatcatgattagatttccttatttgtgtaacactgattttcctggaattaataattgccttattttcatttactttgctttctttgaatctgcatccagtttcccacaccctctgagagctcaaaaagtatctcaacatgaccttccacttatctgatgagctcagagttccatttccccactccttggagtcatctgtgcagggcccacagtccccctactctcatctggacacaatgtttctaggctggctgcccggctgtcatcctgagaattcctgtgcctctctctgtattgatcctttgttttttggactctgtggagtcctcttttttgatttactccctcattttgatggagcacatcctccagtagctacaaaaaggttgtgtaggctgtaactttggtttcttgggagactttttattatatatattgataaatattatatataaatatatacacacacatacacaccgttacatttgattgccaaggtggctgaaattttggatgagtcatttttactcagagttttgaagtttttgccccattgtcatctaatttctaatgctctttttggaagtctggcttttctttttcccaatgctttgtatgagatgtatttttccttcctgggagcttccttttattactagtatttcagaattttactatgatgtgttttgagatggatcattttgattttttgctaggcacatggtgagctctttctgactggagactattatttttcaggtctgtttttaatttcttttttctccttgccattttttctcgttctccccttcattgatctctccttttcttgttcttgtttggggatactggcaactttttgcatgcctttgaccaaagaatgatcctcctctgtcagagaaggttgccctctttgaccaagtgtgcagcttcaggagggacgcaggtggagcagtgagggaggcaggggcacacccgtctattcagccagatcagctgaatcaaccctgacaatcaatgcggtggcaggtgtcacagccaaattactctcatatcctcctttccttattatttatcaccatttcatatgtccttttctgttctacttttaaaaaagatttcttgcattttatcttctaagtcctctgttgaattctttattttggctgtcatctttatttttttgaaacagggtcttgctctgtcattcaggctggagtgccgtggcacgatcatggctcactgcaatctctgcctcctggtctgaagtgatcctcccacctcatccactgcaagtgtccaccactacactgggataattttttgtagagatgcggtcactctatgttgcccaggctggtcttgagcttctgagctcaagcagtctgcccaccttggcctcctaaagtgctgggattacaggcgtgagccacctcacccagcctatcatatttttaattgcaaaattcttgctggatttcagaatgtcccttgtttctaaccatcttgctttatgagtggaatattttctcttacttttccaacattatttagacttccttttctttcctaatttgtctctgtgtcctataagtgcctaactttctgtttattttgccgtcttgattgtgttagcagctctgctcaaatttctggtgatccttagcttgctcatggtattgaagaatgagaacttaaaaagctgagcagtttgctgtgtgtgtgtgtgagggtaggtcttgtcatctggtgggtctcgctgtgggaggtggatacaactggagttttcatcagggtgctgcagtgtcagaacccaagggcttacctctgaggtgcttcagttcctcaagagatggatgctcctttctctcctgctagggccctgctggggaggactacaggcttgtaagccttgctgctggcatcctagagctgagagttgggggaacgggcctgggtcctcactgttcattttgcaggcttttacctaacttccctgtcatcattctagcatctcaccgaacttctcctttatgtgtggtgctcttatgccagagcctttggtgcattttctccagaaaacagggagtatgagggaaggagcagttacctaagtagagaagggatgggaatttgcttaaaattgtgtcgtagatggactatatctttcttgtgttactgtcctcaaggtctaagggcctcttctttctcttgctacttgccttgatcatgtccatatgttttcctaagttctcattcacgctttctgttttactgaatcttcctctttccctgaactccatcctcctgcttcacattggactgcttgctcagttgacataacttacatcctgggacctcctttcagaagtttcgtcagttgtatccactagtttttgtttgtttatttatttggtaactcctcattttgccagaaaaaaacctcagataacttccgtggaaagggaacatgggaagaaagtatttctgagcctgtgagcatattaaagcatctttgttctttcacattgaagtgatagtttaagcaggcgtagaattctaggttaaaaaattatcagccccattaaaaagtgggcaaaggacatgagaaggtacttttcaaaagaagacatacacacagccaacaagcatatgaaaaaatgctcaacatcactagtcattagagaaatgcaaatcaaatccacagtgacatgccatctcacatcagtcagaatggctattactaaaaagtaataaaataacagatgctgtcaaggttgtggagaagaggaaatgcttatacactgctggtgggagtgtaaattagtttagccattgtagaaagcactttgatggtttctcgaagaacttaaaacagaattaccattcaacccagcaatcccattactggttatatatccaaaggaatatgaataattctaccataaagacacatgcacacatatgttcattgcagtattattcacaatagcaaatacatggaatcaatctaaatggccatcaataagagactacataaagaaaatgtggcatatacacaccacgaaatactatgcagccataaaaaagaatgagaccgttccctttgcagcaacatggatggagctggtggccatcatcctaagcaaactaacacaggaacagaaaaccaaataccgcatgttcccacttacaagctaaacactgagtacacatggacacaaagaagggaacaacagaccctggggtcaacactggagggtgggaagagggagaggttggaaaaactgcccattgagtactgtgctgattacctgagtgatgaaatgatctgtccaccaaacccgcttaacacataatttacctgtataataaacttgcacatgtactcctgaacctaaaataagtttaaaaaaattgaaacaaacaaacaagtaaaaataaaaaaaattatctttctggggacttggaaaccattgctttatttgtcatctagcatgttctgttgctgataagaaatgtaatttcagccttagttctcatttctctgtggctaactttatttggaagttttcagaatactttttttcaaggtgttgtgaaatttcttaaggaatgatttaccctcagattttgtcatggatggagccttcttataatcctaatgccaccttctcagagaggctttccatctctgcccaatctaggggagcccgctgtccccccactcttgattacattatttctccttagtttcctcatggcacttaacattatctgaaattatctcatttaatgatttgctttgcttttgtcccctctgtctaaaatatgagctctttgggcactgttcgtagagctgtgtgtgtatatatatataatttttttttggaaacagaatctcgctctgtcgcccaggcaggagtgcagtggcacaatctcggctcactgcaacctccacctcccgggttcaagcgattctcctgcctcagcctcccgagtagctgggattataggcatgagccaccatgcctggcccagctatctatataacagttgcatcctcaccatctaaaatatgtatgatatttgttgtgtgaatgaatgaatgaacgaatgaatgagtgcctcggcacagggctttgttcattcattgtactaggcactttctgacccttttaatgcaacatatgtctttttttttaaactcattttctcttttccctgtgttctctagtactgttgttagtcagatgttggaacgtatggactggttgcctgtgtgtttaatttattctctcatattgcatgcttttgtcttttgctatgagagatttttttaagccttgttttctatctttatgtacattttttattttgaggatttttttctttgctggattctgagtgttcccttttcatagcattctggtgttgttttatggagtaatgtcttctcagatctctctgcacatataattaggatctttcttttaactttgtttttatgccttgcattttatcattttgttttaaagaatcagtttttctgtttgtttattctgggctttgcagatgacaatactcagcctaacatatctcagatcgtgtcttttctctccctctacctcaaatacaagaatgaggggattttattcagagttctcaacatctagagtagaagtttagctttttaaatttcttccaggttccttagagaagcacttcctgatgaatttctgggccgtaaattggagatgggaggcaacggataaatgagaatggaagggctcactgatacaatttgtcttccttagatctccagggaggcccacagttttttctccacatctcacttttgccttctgtcacatctgctcactttgagctcagaacccatggagattcgatcgggcaggctggctcctctttctccaaggcggcctctgcctgtctcacataaacccatgcctatctacttgccatttttgtggagtttggtgtcatgctttccttttaaccctactctgcttttatttcaagtgtgttctcagaagggaacggaaagcacagtccacgtcttacctgcttttaaacagcaagtttcctcaagactcttaaagcccctgcttaacaccacacctacctcacccatcctgaatcaactgctgctgggcttgcccagcactgctgggaaaaaattacataatgtgctgattggctccattacaaatgtatgagttccaatcttagcaggacctcatatttgctgagcaatccatttacttcatcccagtcagctttctttctcatgcccatgatggtggctctgtttttatttttaaacccatttcttcaagtcctttatcataccctggtcttgtttttcttagcagacaacctagtagcccatattagttacaggtgaagttatgaagaatgaactttctgaacttctttcttccatcccctcaaactcatctgtctaacacagtattgttttcaaaggcaagtactggctccatcatttcctaactgtgtgaccttgcaaaaaaattacataccattgttgagtcttgggtttctcatatataaaattggtgataatgtcaatctctcctggttacaagcataattaaagttcatctctcctggttaccagcataattacttatacatttggttgaaaacattaaaatagtgcggaagggttaaaaaaaaaaagagagaagtcaatgtctccttttctcatcctcaacctttcttttttttattttttatttttgagacggaatctcgctctgtcatccaggctaaagtgcagtggcacaatctcggctcactgcaacctccgccccctgggttcaagcaattatccctgcctcagcctcctgagtagctgagattacaggtcccgccaacatgcccggctaattttcgtattttttagtagagatggggttttaccatgttggccaggctggtcttgaactcctgaccttacgtgatccgcctgcctctgcctcccaaagtgctgggattacagatgtgagccacgatgcctggcaacctttagtttaaatcatgtgaatattttaaacaaacatttgtagttttgataatgaggatgatacagggaagtttctcatatttcctagcacagaatctagcactttgtatatgctgaaaaaagttagtttcttatctctactcccttcctttctggatcatgcagagcaattccattttcttctttaacagatgaatgaatgtctggcacctacctctgctcagggatgttactcatatagtgaggctgcaactcttatgaactcgacggaaatttacatctttattatctaatccatgaattacagtacaccttttctcacttagttgtattcaatctagaacaagtaacctgactaagagtgctggaagctgctgcaaggacccaattgttttagtatttgcagtctgactttaaaggaactttataaattgtagcaaaggaataactcagtttccatggagaatttttctggtttctcaagtcctaggaatacagtctagaatgacttaatgaaaacactactgggtggtgcggctgtataggcgtgccacttttagagtagcagatacctttgcgtgaacaaaaatggaatcctttctccaagcagggtgtgagctacatttcagctttgctcccttggctgggtgcccttgtgcagtgtacaacctgctcaacagtatgtggctggcctgcctagtaaaaactgtttcttgttctgcatgattttaagacttgcatgtggcttttttccctttcaagtcaataaagagaaagatgaagggagtggcagtgaagagaggagtctttgtaaggtacatgtttggttcagtgtgattggcacttacacatgtcttatgcttacaacatccctctactgtttatattattatctatgttttagttaaagaacctgaggcttagaaatgaagtgatttatccaaactcatcagttaataaggagtggagctgaatcagatctagatgatttatgtcagagtttgcattctttctgagcacctcactgaggtgctgttttaaattgtgtatttcatgcacgtacgcacctgcatgcacacacaaccttcttgctgaatgagctattggggatgtatctacttctcaatactgcatggctttctgatatttcaaagcagctgagttacaggcatcgtgctacatgctgtgcatgcctacagcatttgctctgtggctctcacatcagccagtctagattttcacctgagccttgccacatactggctgtctgagtatgggcaaattatttgacttttctgggcttggtttctacatctttaaggtgagactacagatagtatctatctagtcggattgatgtgaggattgagtaagatacttggccaattctttaacctttctgtgcctcaatttcttcaacattaagatgtgatcaattatagtactcatctcttaggattatagggaggataaaatgggataaaattcataaattgtaagcaattgataaataactatttaatggtatttttctccttattaatgaggataaagtctcagagaggttaaataacttgcttgaagtcaaacagctagaaaatggctgagctagggtttgaaattaggtttctttggttctggatgcaatgctgcaatacttttgattattacactattttgacagaagaaaaaaatacaaagaagaaagcatgctatataagccagttccattcattaaagtttatgtgaagggcttcaggtttacaggcatggtgaaaagacttaatgactgacccatctttgattagtatcaaatactcataagtcacctaagtgcctgagatggggttgggatgttttaggagaatgagcttttcctgtgaagccaaaatggaatcacagtctttttgtagaatgaacctgatgtgttattagtggttttcttagaaaattcagatttgatagccaagatatggaagcaacttaaatgtccatagacagatgaatggacaaagaaaatgtggtatgttcatgcatcacataacaatgtttcagtcaatgatggacatatacaatggtcatcctgtaagattgtaatggagctgaaaaattcctattgcctaatgatattgtagtcataaggtcgaagtgcaatgcgttggtcatgagtttggagtgatgctggtgtaaagaaacctactgtgctggcagtccttcaatagtacagcacatgtagttgtgtagagtacatagaacttgataataagcacctgtgttattggtttatgcatttactatactatacttttaatcattattttaatgcatactctttctacgtattaaaaaagtcaactgggaaacagcctctggcaggtccttcaggaggtattccgaaagaaggcattgttatcttaggagatgacagctccatgcatgttatggtccgtgaagatcttgagacaagatatgggggtgggagacagtgatactgatgatcctgaccctgtgtaggtgtaggctaatgtgtgtgtttgtgtcatagtttttaagaaaaagtttaaaacggcaaaaaaagaaaacagtttatagaataaggatatgaagaaaaaatacttttgcaccacagttcaatgtgtgctttaagctaagtgctattacaaaagagtcaaaaagctaaaaaataattacaaagtgtataaagtaaaaaaattatagtaagctaaggctaatttattattgaagaaagaactgtggtttttaatggatttagcgtagcctaagtgtacagtgcttatgaagactacagcagtgcacagtcatgtcctaggccttcacattcactcaccactcactcactcattcactcacccagagcaaattccagtcctgcaggctccattcatgataaatgccctatacaggtgtatcattttttattttttatacttttttattttttgagatggagtctcactctgttgcccacgctggagtgcagtggcacgatcttggctcactgcaagctccgcctcccgggttcatgccattctcctgcctcagcctcccaagtagcttagattacaggcgcccgccaccacacctagctaattttcttgtatttttagcagagacagggtttcactgtgttagccaggatggtcttgatctcctgaccttgtgatctgcccacctcggcctcccaaagtgctgggattacaggcgtgagccaccgcgtccggccttatactttatttttattgtacttttcctatgtttagacacacaactccttgccattgtgttgtaattgcctatggtattcagtacacaaatatgccgtacaggtttgtagcccaggagcaatagtctatactgtatagcctaggagtatagtaggctagaccacttaggtttgtgtaagtgcattctatgacatttgtacagtgatgaaaccacctgatgatgcatttctcagaatgtgtccctgtcattaagtgacacatgactatatacatacaatggaacactattcagccttaaaaaagaaggaaattctgcaatatgcaacaacatagatgaaccttgaggacatcatgctgagtgaaaaaagctggtcacagatttcacttacatgaggtatctaaaagagtcaagttcatagactcaaagagctagaatggtggtcatcaaggctggggcgattgggaaaagggttgttactaatcaggagccatatagttttaatcaagcaagatgaataagctctagggatctggtgttcaacatcatgtctagagtcaacaatactgtattgtacacttaaaactttgttaagaaggtagatttcatgttaggtattctaaccaccgtaaaataaaacagaaacttcagacttaaaaatctgatgagttttcattttgaaagatcgtgagagctctagcaaaatcctggcccatttccaactcacataattacattcccagcactcacaattttcctccagttttaattaagaaatgtgttttgcttcctctctgtggctgccagactgtacttcatacaggtgtgtcctaatcaccttggacccgaaagagctggcattgaccatgaaaactttggttaagtgatgctttacataaatccattgtgtaatgtgagttattgcccctcactctgccttttcttcaaataattttttaaatggggttaagtctgatgtctgtataaagactttttaaccagtgctatgtgctgatgaatcacttagtacttacttactgtctatgactatctttcatttatcaattgtcatctttttgaacttaaagcaaaatctattatattatctgggtttgtgacttgagctactgagctgaaacttctccaggggtgattcttgagctaccaaatgaccaggaagagttttctcagttttctgctcttggccgagactgttggacaggatgattcactcagttccacccagctccgaaatatttccctaaagtatcttctctgaatatagctttattgccccatcgtattcagactatagaaattaaataaatacagtctgttaattcagacctttgccacatgcacaactcagcttcctcttcaccacacttgattttaccgtaggacaacatggtgtctttagatagttgaccagccctcccagttgactggcatttctggccatgtcattcctaaatccttcaattatatcattcaaaccattcatctccttgcctgtgtctcatgggtagcttaatctacttaagagttttttctccattgtttaaatattttagcaccattccacaaaggcccgcggcgggtgttgacgcgatgtgatttctgcccagtgctctgaatgtcaaattgaagaaattcaatgaagcacaggtaaatggtgggagtaactatgactctcttaaggtagccaaatgcctcgtcatctaattagtgacgcgcatgaatggatgaacgagattcccactgtccctacctactatccagcgaaaccacagccaagggaacgggcttggcggaatcagcggggaaagaagaccctgttgagcttgactctagtctggcatggtgaagagacatgagaggtgtagaataagtgggaggcccctggcgcccccccgtacccgcaaaggggcggggcggggtccaccggccttgctgaaataaaagaggatacaaacaaatggaagaacattccatgctcatgagtaggaagaatcaatatcgtgaaaatggccatactgcccaaggtaatttatagattcaatgccatccccatcaagctaccaatgactttcttcacagaattggaaaaaactactttaaagttcatatagaaccaaaaaagagcccgcatcaccaagtcaatcctaagccaaaagaacaaagctggaggcatcacactacctgacttcaaactatactacaagcctacagtaaccaaaacagcatggtactggtaccaaaacagagatatagatcaatggaacagaacagagccctcagaaataacgccgcatatctacaactatctgatctttgacaaacctgacaaaaacaagcaatggggaaaggattccctatttaataaatggtgctgggaaaactggctagccatatgtagaaagctgaaactggatcccttccttacaccttatacaaaaattaattcaagatggattaaagacttatatgttagacctaaaaccataaaaaccctagaagaaaacctaggcattaccattcaggacatagccatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcgcaagctactcatctgacaaagggctaatatccagaatctacaatgaactccaacaaatttacaagaaaaaaacaaacaaccccatcaaaaagtgggcaaaggatatgaacagacacttctcaaaagaagacatttatgcagccaaaagacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccatggtggaagtcagtgtggcaattcctcagggacctagaactagaaataccattagacccagccatcccattactgggtatatacccaaaggactataaatcatgctgttataaagacacatgcacacgtatgtttattgcgggactattcacaatagcaaagacttggaaccaacccaaatgtccaacaatgatagactggattaagaaaatgtggcacatatacaccatggaatactgtacagccataaaaaatgatgagttcatgtcctttgtagggacatggatgaaattggaaatcatcattctcagtaaactatcgcaaggacaaaaaaaccaaacaccgcatgttctcactcatagatgggaattgaacaatgagaacacatggacacaggaaggggaacatcacactctggggcctgttgtggggtggggggagcggggagggatagcattgggagatatacctaatgctaaatgacgagttaatgggtgcagcacaccagcatggcacatgtatacatatgtaactaacctgcacattgtgcacatgtaccctaaaacttaaagtataataataataaaaaaaaaattttagcaccattcaaaatcatttattgtagatattactaattttaacggaagtttctgagaattagaggggaaagaagtttgcttaaaagagcatagacatacatgtttttggattatcctagctccttctatttatagtcttagagttcatttctagatgtaaatatatgagttcgtcttttttttggctctatttggagacacaatgtttgttttacttcgttttaggagtatcagggggataaaaactataagcaaattttctttctgccaagtttgaaattttgtaaccaagatctaaacaaatcaacatgaagtctgtaaggtatcatgttttaagatatatacccttaaaacatgataagtttttatttcaaaaatgcctatgagtatcattaaacttaggaccaagtttacctttctatacccttatattaacatatgttatgttatattatgattatgtatatgttaaaattatatatatgttaaaatatgttatattaacatattaacataacaatataatgtaatgttaggaggagacaaaacagaatttaaaactttacatacaatcttggtagcaatatgttattaatgttaatctatacgtacattgagaaaagaccagaacaaaatatactaaaagcattaaaagtggatatcgctgggtgttagcactatgcatgagtttaatttttttgtctttgtgtattttaaaaaatttctacaatgagtatgtattactttaataataaataaagatattttgaaaagccatataagtgacacattattttatttgaaatgattttggacttaaagagatagtttgtacatattgtgggttattacatgtaagtttcaagttacacctgatttaaatttcttgtctacaaagctgaagggagctttaatgataaaaataacaattagacgcagtaatcacaatttccttgaatatagtcctcttctaaacctatgctagcacatatgctatgacatactgcgctttgttgattagtcttactctccttcgtgtagtcaggaggggtatttaatagccatagacgaaaagatttggcccaaggtcacatagctactaaatggcaggcctgaaactagatctccatctagttcttttcccaccattctctgtaggagtaaatttaaaagctattttatcctttttgaaaggaaaaatgtcatggtagccttttgcactcctcacgtttgtgattgtgttactgctattcattcatgcttctgttaagtgcggaaagataccaatatcttagcgcgtgttatgtcccaggcacaatgctggacactggccatacattcacccgcctaatcccccacaacgactgtgtgatactgacattttgataactgtttacaaatataaaatctgaaattcacagcacttgtgaattgtggatatgaaattgaacccagctctttccgactcacactcaggaacactgaaagcagagtgcgagaaaaactgcattagagctttctccaggaagaagaaagcgaaataagccacccagaagacctgtgctagaggagtaaaactagggacagttacacaaagcttccctgccagtgttggggcttacagatgcacactgtggtgaaagataaaattgggtttaaatccatttctgacccttactagctgtgtgactttggcagtgcctatcctctcaaatcttcaatttcttcgtctgaaagatggaagtgtggcaataataatgacaattctcatggggaatgaatgagacaacttatgctgagatctcagggtgcaatacatggaacaaaaatagggttctgctgatgttagttttaaatgataatgatgattatgacgatgataataatatttataaacctgaagttgcatagctctgtatagccaaagaagggttctcatatgaagccaaaaatttaagtggcattgaaaagaaacattctcattgaagtcttcttgaagactgagataaattgatgaagattaagaaattatgagaaagatactgttctagtttattagtatattttgctaaagaggtcttctctctcttttttttgctgtgtgaagcatgttcttttagtccacgtggcatgagcatagtatgtatggatttctacttgtcacatcttttaatagagaggaactcaaaaggaggcagaagtcccttaaaaaagttaggggacttctctttgatttacagagaccagtagaagtatgtagtagaagtatgtttagatggggaagttgaagtgttctttagatcttggggtagggtgatgggacacaattgctgtggtgtgaatgtgatttttgagggccactgtgttcttacatacttagctgtaatgaccctatagcagaaagtgtttgaattatgtttaacaatcatctgtcttgctgttatatattactttacataagcatcgatccctgagtgattgatttcacaaagattggataacaaggttgttgtttttacttgttttctcttttgctgtctccccagggctggttttcttgaggcctcaatgattgtggggcttgccatgatacctcttatagtttcccattctttaaagttagcaaatttgccagataatctcagagatccctccatctctctagctctgtaattccatgatttttatagtaagatgaaatgtgtgactctcaggcttacattgtggaccacccagttataaggtattgctatcgaggccccgtgcctcactcaaaattaacacttacattgattcttgagttaacacgattctcttatctggaggactaccttcagtaagaagcccttgtgcattttatgtcttgccagaaatgctttttgtttgttgggaaggtgctgcacagtccttttgcacaaggatgagggcagccttcagtaaatagtccttgtgcattttgtgctctcatgatgggttctcttcaggctaatgagagattgcttagtgttactcaggtttaaacatttgtgctattattagaatccagtatgttttctggagagtgaatgacaatcagacaggacatgattattcttaaaaatgattttcagcacagtgtaaaggatgaaccacgtcagcagctttttgtgtgtgtaccatgatcaccttctctcctaataactttttcatgaatgcccacttcctttcattgctatttatatttgttgcatgtattgattttcttagagcctttcatttcatagcatttatttgtatcagacaccatgatctcataagaaaagcaaacataccccagggtgacctgggtctgtgctcgtttcctaaactcaggaaagctttttgcctccttgaacagtgtgaaagttggtctagaacagagtgtctcatcctcagcactattgacatttgggccagataattccttataatgggaggtggtgggggccttcctgtgcattgtagtgatgcaggcaaaacctcaaaattgggtctcagctaggaggagttcttggctttgcacaggaaagaattcaagagcaagctggcagtgaaagaaaacaagtttattagagaagcagtgtacagcaaaatggctccttcatagagcataggtggagtggcccagagaagcacttgtggattgctggctggctatatttatacccactattaattatatacaaaataaggggcaggttattcacaaactttctggaaaaggggcagagagttcccagaaccatataaggtaacttttgggccatttgccatggcatcatttataaactgccatggtggtggtgggagtgtcttatgcaaatgtattataattagcatataattagcaaagcaactagaggtcgctttggttgccatcttggttctcctggatttggccagtttctttgctacatcctgttttgatcagcagggttgtgaccagggctcagaaagcaggtcccgctgatctcctacctcagtaggaactactggcccattagatgcccgtagcaccccctcagttgtgagaactaaaattgtctcctgacgttgccaaaggtcccctgggggggcaaaattgacccagtggagacccactagtctagaataatatttttttaggtatatacaaactttaagatgatatgacactaggagtttgtgaatgtaatgattattagagtcttgtcatactttttttctatggagcgacatgaatgaaaaacagaatttatttgccttttgcattgttaggaggatttcttgataagactttaatattgttttgaatttgtttcccccattaaaatttaaggactcattatcaaagtttgaaagaggccacaggagaaaaacctttgaacaaacaccaattaacacgcatgattgggatgggctatgctactgtataagtggtaccagcatagtcattaaagataagtcttggccaggcatggttgctcacgcttgtaatcctagcactttgggaggccaagggggagtggatcacgaggttaggagttcgagaccagcctggccaacatggtgaaaccccatctctactgaaaatacaaaaattagccgggcatggtggcaggtgcctgtaatcccagccactcgggaggctgaggcaggcgaattgcttgaacctgggaggtggagggtgcagtgagtggagatcacgccactgcactccagcctgggcgacagagtgagactccttctcaaaaaaaaaaaaagataagtcttggtggcgagggagggagttgaggggcgagaaattacctattgagtgcaatgtacatcagtcaggtgatgggttcactaaaagcccaaacttcgctactacacaatatatccacatgacaaaactgttctttcaccccctctaaatctatttcaaaaaagataagacctggtacgtaacagacattccaaaatatttgttaaatgggtagatactggaaaaatggatggttggatgaaggatctgctattgctaactcatctagtcttgggaacaacatttcatcagtgatacacaaaactggtggtcacaaaagcaaaagcggtcatggggtacgagcagtacagagcgcctttccttttcctgtggatcccccaggtgctcctctgctcttccaccgctgtttgtttacactcttctccccaggcctatatccttacctgcctttccttccctctatatttgttgcctgaatttattttcttcaagcctttcatatggtatcatttctttgtatcagacaccatgatctcaagaaaagaaacccaccatatttgattgtggatccacaccggggcaatcctgagtgaagaactgcttaatctttattctctggttgtttaaatcaaactagcaatgtgattcctaatcatctttgaaaatacttcattttgattgtctagagccccaatgcctttctttgataatttattctagaatacaagtttttggtcgaaggaacgtatattaataactgggatagatggattttaacagtgatcatgtgctcacagtgatgttattgattcaatactaaaaagtattttctccattttataaagaaattgaggtacagatttgttaagatgtagagcctggcgcctacagtaagtgagtagttatattagggttggaattgcagagcccagatgttgagaccaggttcatagcaccaagagggagggtgaaattgatgtggggcagtaatttgataaaaagcattgaatctgtaataccagtaagttgaaacatttttctttatgttttgttttaaagtcacaaaataattgttgaggatgactactttgggtatcatggctttgattcaatgggaagaatattttctctaaaatggacaaattattaatttcaagacctttcctatgagttttattttggtaagtgttgctcatgatctgcttctcttctctcttagaccttctctcaccatgccccataggaatctgacaggaagctgcaacgttaattgtggttgtaaaatacacgagtatgagccagtctgtggatcagatggaattacatactttaacccttgtctggctggctgtgttaatagtggtaatcttagcactggggtgagtatatttcacaagttcctcttctgttagtccaacatcctgtgacaaggatgtgatgaaattcctatgcagctacaatgacttcagtctttcttttcaagaggctccaagtaacctacaaaatacctctgatgaaaacctagaggaaagaaaattatgcattgctattatttttttttccagggatgactggaacatttgggtgcagggattttgttccatatcagccttctcctactttatattctgcgccaagtcagtgaaacttgataaggttgagctctaggcctgccatttgtttctctgacagggcccttgtgatggatttgaaggtcaagatgaccacatttggtgctgataaaaaagtataggaaagcacctcccctgactggagtctgtgaagatgggtgatggccatttttcatagactatatcagttcagttccggcttaaaaaaaaactttcaaagtaaagatatttctgacagttcaagaataggctattttgagaattccctttcctgtaaattataaatgggctgtaatactgtgggagaaggttttcatattctactgtttcttttttttgagatggagttttgctcttgttgcccaggctggagtgcaatggcatgatctcggctcacctcaacctccgcctcccaggttgaagtgattctcctgcctcagcctccctagtagttgggattataggcatgtgccaccatgcctggctaattttgtatttttagtagagacggggtttctccatgttggtcaggctggtttcgaactcccgacctcaggtgatctgcctgccttggccttccaaagtgctgggattacaggtgtgagccactgtgcccggcctctacacagttacttattgagcccagtttgattctttgtgaagaacagattgtacgaagttgctttcactaaaaggttaaaatgcatgtgcttgttctgtgcaggtgataagggattataccatccactgaatgttttggggatattgtttttgatgtctgagttttaaactgcaatgataaattgagaattcctgttgtttgttccccattatataattggtgaactccactgtgtcgccatgttgaaagggtgagatctgttctcttggtggcgaagtcctttcttgagagtgagtgttcatcctttaaaatatgccagcagtcttttgagcatgacagccaaacagtgccccatcttcatactttttcttatgactgcttcaagtattcaaaggttgcaatgaaggccagctgatgtccatttagtctgactctgtcacagtccaggagcagtactgggtgggggctgtagtagccaagttacatccatggagctggttgctcttctatagggtgtagggcaccagctaactaaagggacttcaaagatgtttaaaaatggaagcaccagaatgtatattaacttagacaccgtggaaagcagtttggagatttctcaaagaacttaaaacgaccactcaacccagcaatctcattcctgtgtatgtatccaaaagaaaacaaattgttctaccagaaagacacatgcacttgtatgttcatcgcagcactgttcacaatagtaaagacatggaatcaagctaggtgctcatcagtgatgaattccataaagaaaatgtgataatatacaccatggagtactacacagccataaaaaagaataaaatcatgaccttggcagcaacatggatgcagctggaggccattatcctaagtgaattaatgcaggattagaaaaccaaataccgcatgttctcacttataagtgggagctaaacattgggtactcatggacacaaaaatggaaacaatagacactggagactactagagggtggagatggggagggaggtgtgaaaaactacctgttgggaactatgctcatgatttgggtgatgggatcatctgtacaccaaacctcagcatcacacaatagacccgtgtaacaaacctgcacatgtactccctgcatctaaaataaaagttgaaaaagaaaagaaaacggaacaccaatgagatgttcactattattggcgctaaagtcatcacgattgcactataaattctctgcatttaatagatgtttactttagggcccactgtgtgcccagagttgtgctaggtgctctgtgagcacaaagaaaaataaggtttggatctgttttttgaggggcttctctaattggagagcccaagagttaacagcaatggaggcagaatataatgatgacaaaaatgagcctgcagaacgtgaatggtattgaatgttgaaagcttcttagaaaagtttaggtttaaacaattttgaccagcagactttgattctgttagacacacacttgagatccttactgttaccaatgaggaaggtactttcaatgaaatattttgtgtttgaaaaaatatttgagctattttagagtacttttacttaactttgtcttaatattcttatgccacagttagcttttgaggggcacacaactcatctttattttgctcacttagatacggaattatacagaatgcacctgtgtccaaagtcgccaagtgatcactccacccaccgtgggacagcgaagtcagctccgtgtggttattgtcaagacttatctcaatgagaacggctatgctgtgtctgggaaatgtaaacggacctgcaatactcttatcccattcttagtttttcttttcatagtcaccttcatcacagcatgtgcccaaccatcagctatcatagtaacactcaggtgagaacagcattcaacttctggggtgggttctgtacttataatttccagagcacataatccaggacaaggggcttatgtggtaaatcagagagcaaagcaaaattagcatgtgcaggagggcgctcagatatttgcctggtgaacttaggagggatttttccctgttgggaagggaaagaaaggttgtaacatttcatactttggaaagttctttattcagttgggttatattcttactgtataatgaaacgtcttttgatgtttttgattcctgaagtctctgccctacgaggttcaacttcaggagttgaaagtcatcactctgtcagctgtgagaagctggaccccagaggagggcaggaagtaatttgagaaagttgctaaatcgtgcatacagcaaaggctattatcttcaaccttatagatagttactgccttcaggatcagtggtgatttatgctgggcctgcaatttgaaatgctgagttcattaattttactatcatataaaatttcagagttgagtcaagaaaagggcatattggggaatgtgatttctccctttttttttttttcagtttttcaggctgtgctttctttgccatatcttgtttggattttttgtttataagaggacatggaagctacttttgtcctattaaaaatgttggcactggtgttcctggaccaaaatgatggtcgggctgctatttttttgcactgcaataacgtgatacagatgaacaggggaggaagagggtttttatttctgtaaccagttacagggagaaggcctggaaataaacaccagaccaactcaaaattacaaagtttattagagcttatatacattctaagctatctgtctacgtgtaagtgtgcattcatctaaagacataagtgattaatttcttttaatttataactaagatctgaatcttgaagaccttcttctggagcctcagtaagtttacttaatctaaatgggtccaggtgctggggtgattacccttatcttgtctcctgctaaatcacggaggtttggggagttccttcagacccccaataaacctgtttatggaggcctagggagttttttcagacccccaataaaacttgtttaatcctaaatggatcctgttaagaatttgttcattattttgtcgtgctttaaggcccaggaaagacttaggcaaaattcttggtggacttttgttacattccagcatttgtataagggcactggcttttaatatttaacttaaacactcagtctgtactgaaacagttgttatggaggcctgccacgctgatacattcacatcggtgtgttgatatttacagtaaggactgcagtggacaaaggaactgggcagcgtggtgaagccagaagagctcacccatgggtctgggcagcttctgcccagattagggggtgcagtgcagggaaggggattaggggggattagggggtgcagtgcagggaaggaatgaagaaagggagtcagttcttactctttctccaggctcctcagatgccacaatgctgggcaccttgcaggaagcacctgctgagatgtcattgcttagcaagggcagttggctgcaccagatgtattctggcttccttcccacttggtgctgaatcaggcatttcccagcaaagctgttccttgacagccagatagtagtgcatgaaaggcccactggtttgtttactcagttcttccagcagcagatatttatggaataacaacctgtgtgcagcactttgcaaattgctctgagaaataaagaaattggggaaaaggtgacaagggcactggtcttgggaaagttcctattatataccatactctcatgggtatgtgatggagaggttaaggtactgcagcattaaaaagacatgaatcattcataaatttactcaaataatcttattctttgcactttaattcctcaagagatgttaaataacccattggctactttttcttttggtgttcataaatggcaaatcgccagttggcttctaacctaaaatttcagaaaaggagccctttaatctttgctaattacagaaccagttgactccaatcttcctgtcacatgggaataacttggagtataagtttttaaaaaagaaaaaaagatgtggttggagggcttatgcttcctctgatctttgacttgtttcctatacattttttgaatatacttttattctttactcttctttcttcctgttttggaagaattattggagtaattttcaatgtatgcatctaccactctggaagatgcaggcacacaggcaaaaaaacaaaaacaaaaacaaaaacaaaaaaaccgtgcagtatttaagatgaaattctataattaaaaaaaaatggatctgattttggaagctcagttagaggcattccagcttcttcagccaaaagcctttaaccctctaccagtatttttgtagaaacaattagagatagtcagagtttctttgatgtctacattgggaaaacctttattcagggatttagccaccagcaatcttgtgtggctattgttagtaaataatagtgaattaaatattttggcatggcatctttagtccctggctctgcacaaagccgacttgatttgacattcattttcttggggctactatttaaaatgcatttccttctttcccttcactgtaggtccgtagaagatgaggagagaccttttgcactgggaatgcagtttgttttgttgcgaacacttggtacgtccctgaatttccaagtgtacctcttagttcctctttgcagatggcaaattttcactgtcctttaaaaatggcaagtcatgtcatttattaccatgaataagattttacaggctagtggtgagggtacaacttccttgttttctgatttgaactagaagctgacaggttctgttgtttgatgaaacaaaacaaaaccaacgttaggttagtttctttttcattatgaacataaacttggacaaaattccccagaattttgcacagtaagaaataggaaatcaagcaatttgtgaagaatttgtaatcctagcattttgacccctttatgcctttttactatgaaagcagtagaaattggtctttatttgtgaagttttcaatgcctcacttctttacagtaattttattggactaaacaaagagtatacctatcaagttttctgagaaaaagaaaaaactttaaaaaggaaaagaaaggtctccaaagtgacatatagggactgccttgtaagtatttacttatcaacaagagaagctcagtagtgctgtgtccatgtgataaaccacagagtacatttgtacgggtggaacataggtcttatttttacaaacaccacatccctctgtgagttcttgagacaatgggaaataagcatgtaacatacaacattcctttgatcagtttcaatgtattttaaattgacgtctttgtcatcaagcttatttttccttttataatgtctttttctcaagtggcagtctgtcatttccttcagctgttattttctcctcagtaatcagtgtcattgtctacaagacaaaaaaattgctttttgattcaaatttcttatttcagttttgaagaggtaatgtttaaaaagggcatcttctgaccccctgaagcatgaatcccctggcattctccatttgtcatatgttgtggttgatggcccagtccaagaatgagcattttcaataagccccaggaggaaaatgcttctagttccatttaatgagtggcttgtttttttcagtactaataagactctgaggctatcattttttaaaaaacatgctgtttaaaggaaatcctgacacacttagatatagtgaagaagtctgccttaggccgggtgcagtggctaatgctttaatccctgcactttgggaggccgaggtgagtggatcacctgaggtcaggagttcgagaccagcctggccaacgtgacgaaaccccatctctactaaaaatacaaagaaattagctgggtgtggtggtgcctacctgtaatcccaactactcaggaggctaaggcaggggaattgcttgaacctgggaggcggaggttgcagtgagccgagatggagccactgtactccagcctgggcaacaagagcagaactctgtctgaaaaaaaaaaaaaagtcagtcttatagatcttgttaaaagttaaacagtattatttagaaataacatttagaaataaggagatttgttaaccaaaggggtaattgaataagaaaagaaatatatatgtatatatatatgtattttttttttggagacagagtcttgctctgttgcccaggctggagggcagtggcacaatctcagttctctgcaacctctgcctctagggttcaagtgtttctcctgcctcagcctcccaagtaagtgggattacaggcacttgccaccatgcctggctaatttttgcattttttttttttgtttttttttttagtagagatggggtttcaccatgttggccaggctggtcttgagctcttgacctcaggtgatccacccgctttggcctcccaaagttctgggattacagatgtgagccacaatgcctggccagaaaaagataatttcttctttttgctttgcccctctctgatgccgtggagttggggtcatttgatatgatttggaggtaaaggtgagtcaacagatgtatgctacagcatcaagaataagtggagggagaacatttcagacatttattatttaattcaactttattttaacttctatggattgtgaaaaagtctagttgggccaacaagccaattttcatttccccccaaattctgaagcagaaaaagagttttaaaaactttaataatattaaaattaaaccaatagactttattttaaataaaaacaacttatttaaaacgtatcactcacagcttcctgggttatcagcctgcctatcctctctgccttcctttctgtcttcctggctcccttcctcctttctctcttttattccttcctccctcctccctcccattgctatcttccataaatttttattgaggtctttgggatgcaaagaataaaaggcgtggcccctgccttgaagaagcttatggagtgacaaatttgtaaacatttaaaatgctatgtgatagttaataaaatggaggtagatccaaaatgcagtgagaatatgatggcatctgagtaagtcaggaatttaaagggggcatagatatttgcaaagtgaatgagttgggggaacattttggtaaagggagtagcatgtgacacaggagtctatgtactaggtagactttttttctcattggattaaggaaatgtctatgtcatagcccagacaacgaagctactattcatctcagatgtttcacaaacttcaaagatgaaatttatgccataataaagttccttcatatatataatttcttagatttataagtgcttttacaaagttgccatgttatgtggtttctgactcataggagatgctgcttttctcgtacttttcctgcatccaaggactaaagcccaacccacaagaactaagcgtatcgaattttggtgggtaataaagggttctagtatagcctgttgaatacttaatgacaaaatccaatttttaagattaaaaggattctctaattgtatttttagcaataccccttttttcagctttattgaggtatacttgacaaatacaattgtatatatttaaagggtacaacatgttgatttgatcctaaaaatcaacagcgcattctgggtggctaactcgactttaagtgtttatcatatagtgaatgcttttatgataaatatattgtgataaaatatgatgcgtcttaaaaaaaatctggtaacacaagaaaatccctcccctcaactggttttagagcacacaagtaccttgctaatttacaaacctgttttcccttggaagatgtgctaagtcttcgtattttcttcttctccacccctctagcatacattcctactccaatctactttggagcagtcattgacaccacctgcatgctctggcaacaggaatgtggtgtgcagggttcttgctgggagtacaacgtgacgtcgtttcgttttgtgtattttggtttggctgccggcctcaaattcgttgggtttatttttatttttctggcctggtactccataaaatacaaggaggatggactgcagaggcggaggcagagagaatttcccctgagcaccgtgagtgagagagtgggacaccccgacaatgcccggactagatcttgcccagctttcagcacccagggagaattccacgaagagactggcctgcaaaaagggatccagtgcgcagcacagacctacccggggcccttcccagaagcaataagttcctctgcggacccggggctggaagagagccccgctgccttggagccgccctcctgaagcttgaaaatggaagaatttagttttgttggttgaattgaaaatggcgacttgagaaacaactgtgccttcttttctttctttcttttttttaacctctacagacacaatcctcaaaccaacaaaactcagtatacacagccgctattcattgagggctggatacctcaacaagactgagagcctttccccgcttctctccaagaaggagacgttcagctagatttgttcccatttccgttgtgttaattcaaagctcatgctcccctacggtacaggctgaggtacacggttagcaaaaccatgggaaggggaatggcggtgcatatcattaactaacactccaaacaaaggtgagcttgcccaggacttggcatttccaaatcaaagtttttagatatgaacacctactgtgagttctgctacaaagcacaaatgaatttgtctcaactatgcaatttgattggaaaaatgtatgtgcagcatgttacatttactttcacggaataaagcagatatgtttctgaaa

SEQ ID NO: 31 - DNA, 25933 bp, Homo sapiens
tagacgcaccctctgaagatggtgactccctcctgagaagctggaccccttggtaaaagacaaggccttctccaaggtaacagggctgagtcaccccagggtcccaaggccggccttttctcacaaatagctgaactcctccactctcagatccaggggccctggactatctcccattgtatgcaaaaatattttatttccgttgacacattactctttggggcagcttgatggttttattaaattttggaaggaggcttcagccccagtaacagccaatgcctgtttgctttcccaggtcaccttgactgtgctacagtagagacctgggaaatgatgggttccagtgctgtggccaagctctccccagtttcaaccccttccaggccttgctgtccatttttactccactgtcaccacatgttcaaattcttgctttctgctcgagtcagtactgctcacctcgttccaagagatctgggtctatgacactgtgggtgacaccctctgagcatcttttccgagctgtctgtgggtacctgaacctgccccccaacctggcccttgccctacctgccccgacctcagcgagtctggcccagtctgtccctgcttctcccctctggccccaagtgttctcaaatatgcccccgcctgcctgtctgtcactgcagctggcccagccctcatcctctctcccatgaacctctgtggtggcctgctctccctggctcccctgtctccagtttatgttccacacaggtgccaaaatgtctgcaaaaaatggagatttaacatacactagcccttggcttaaaacctgtacatgcttctctgccacctgcaaatgacagtcccatttcctcagcaaacctctgcatgttgtgggaacttatggcttctcagcctcccactcggaacccacctctggtttatgctccagaacatgatgttgttggaccctcccctccacctcctccaggctgagttagcctctgtctcccctcctgccctgggcatggctcttccagtagacacccccacatcacagtctaactctgtgtccacattccctgcaactgctgagctcctggagccaggccctgggaaccttgttcctgtttttgttcccagagccaaatagatatttgatgtatgattgttgaatgcagcagtgagtgaataaagacatgaatggttaactgaaaacattttatcaaaactgttatttgtcatcagagcatgggccggtttccaacagctaacatttaggagtgaccatttgccaggcactgttctaagccctttgcatgtggccattcatttcacccacatagcgccatcaatgacatgctgtcactgcattgcttgtcaaaagggggaactgaggcacggaggctgagcttttactcaacatgccatctatgttgagggacttctgacttggatagccgttcaactgcgagcactatggaggccagtcaggcctggccctgccttggaatttctgtgttattcagggacataatggggtttgtgttgatttttgttgggagtgtgtgggttaatctaggtgcaaccctcacctccttcccttctgatgtcctcactcccattggtcatgtgacccttaacgcccatcccaagctcagtgccaattccttgccccagggtcctggggattgacatggatcccaaaagcccgctgctgagaggacagggccactcccacccccctgactgtttcccagagcagctctggggcagaagtaaacttggacccagggggcataaccctttgcccttttatagtctattagaggaggatgaggtctgacatcagctggttcattgccccttgtgccccttgagcacactggggcccagggagagtcacatccctgccttgtggtacaggccaccggccctggacctgtgattaaacattgtccacaattaatttggaattattatctcgtgatacactccataaagttcagtcacacatcttctttttcttctcccctgcctaatgatcagacaagccaggtcttgtgactaaatgaaccgacagctggcagtgttcatctgattttgcaatgcccttattttgttgttgataaactaatgcaaatagctggttggcctggaactggtgattgggaaacattttaacccttctttccttcctctctatcctaaagacttaaaacacacttcacgcagtcacagaaagagctcatagaccagactgcggggcttcaaagccttctatcttatttaatcatctgtaaatagtttaaaggtaaatatggtaataatactagtattctagactattttgggaagccagctgatgtgaataaagggtcagagttaaaagatattgaaggaatgcagttttactgctctgaggtaggtttcaaggcttgagccaggcttagagatctttgtcctgatactggggataaagtgaagagaatatgaatgggtatgtctcgcatggttagaaaatctttttttttcctgtatttgtttaaaaagcattttgtaacttaaaaaaatacctatacaccttttttttttttgagatggagtctcactctgtcactcaggctggagtgcagtggcaccatcttggctcactgcaacccccgcctcctgggttcaagcaattctcccacctcagcctccccagtggctgggattacaggcatgcaccaccacacccagctaatttttgtactttttggtagagatggagtttcatcatgttggccaggcttgtcttgaagtcctggcctcaagtgatctgcctgccttgggctcccaaagtactgggattacaggggtaaaccaccacacctgaccataatacatcttaaatagaacattttccagctaatatttaaatgactgcatgtcattagaatctgaatgagtgttgtgttaaaatattttgtgttttcatatttatttacttacttatagctacggataagaatataggcaaatttaatctcccgtaaaaattaaaaggcagatgttttcaaagcacagaattacatggtctactctagacattgctcctaaggttgagcagaggggataagagctttttctcttttttcctttcctctttttttcatacaaagttcgttgtagatattttagaaagtatagaaagccccgacaaggggaaacccactcaacccaattttaatgttgttgtcatttcttttagtttttttgggtgcatttctatgtagctatatcctattgtacaagcaatttaggatcttgcaatataaaatgaaggcatgacctttgagctggccaaaagtatgggctgatttttgcaaatgggtcctggcagcaggggacataagtggggaaccaatccccacacaagcagaggtgagctggcttaggggcgagtgcatagctgactttggatgtagactagatttggggaaatttaaatggggtccaagactggaaatgtgtaatgggacagaaggtagaaatgtttaaaatcttaagttgttgagtttgttctcaattttgtgaaaactctttatccctttttgttccccaccccattttctaaccagaagtcaaatatgacaacattcatgatgtagaaaaaccagttcatcagtgtgacttgtgggtgagggtggggacagggccggtgttggtatatttagttttagagatttgctggaaaagtaacatttttgcttttgtctttctttcgttcctccatttctccagaagaatatgaaagtgttactcagacttatttgtttcatagctctactgatttcttctctggaggctggtaagttaagtatttctttgtgttcttgtctgctaagaaaatctgttatttagaatacatgaagtaccttccctaacagagtcatttctcatactcgtctctgttgaatctctgggcacagagcctcctggtcatagacctgtactgctggaagttcctctcagcatcttcgtctcattctctcccatatagagtgggaaactgaggcctagtgaggctgagagcccaaggtcatgtagctagttttggaacaaaagctaaaatctaggtctccaatctaggtccaggcctctttccacttggctgctggttgaaagtgtgatatgggaaattctgactttcatttggaggagatattatgtatagtctttatgaacccacagctggaagtcatcaagatacactactttttctgtttctttccatttcttcattttctctaatcttttctctttttgccaggtgctagctactggggatacagcagggaacagtgcacacagaaatacctgcctgcatagggtttatattcttgtagaagagagagataacagataagtagacatatattgtgtcatatgatggcaagtatagggaggaaaaaagagtataaggttttggcattacagtgggcagaaggttaattttttgaatgtggccagaaaaaaacctccctgagaagctgacttttgagttgaccttaaggaaggggaaaagagagctatttggatatcagattggggtgtggaaatattccagtcagcatgtgcaaaggcccagaggccaagagtatttggcaggctttcagaataaaaatatcagcatgtctggagcatagtgagagatgagggaagtcataagggaccaggctgtctgggtaatggggggatggcagagggttgattatatggaatgttgtgcccttttttagggtcttggcttgtagtctggctgggatgggaagacttcagggttctttgtttaagaccagagaggtgatctgacttacgttttgattcctgttttgagaatagatccgagggagccaaagagagaaatagagaagccagtgaagaggcaagccatgatgatggctttctctaggcaagaaatgttgatggcttgtcaaagggtggcaaggagaagtgagaagtagacaaattttgaaatattttgggaacagaaccaagagggatttggagttgggtcagatgtgagatgtgagggaaagagaagaatcaagaattatctcagggaattttggcctgcgcaaacgcaaggtgaaattgccattgatgagatggggaagatcaggttttcagactggatgtgttaagtttagctgtccattagatgtttaaaaggtgactttgactaggcagtctacagcctgagggaaaggtctgggttgaatatataaaattggagacctcagcaagcggctggtatgagaaccatgagactgaatgggatcatggagtgtagttaggaaagataagaactttaaggactgagccagagattgacttaaattccttggtccagtgagttttctcccctttgctgaggggctccatgtgtgttggagcataccttcaacattaaggctgtttaaggccttagccttcacttcctgcttgtgtatgacctcagagtcatccagaaatgagagcctggtgccttctatgcaatttcctgggcatgcacacagccctgcatacatgcccacccttctgggttccccaggaatgtgtcagagcttttcaaagccctctggaggttatggctctggtattgcagctttaggcagttgtaaaaaacaattaacactgagtttttccagcaaacgccttggggatagtgcttttgctgtggagctcttggtgaggtcaataacaccaccaccctatgaatgtgactttgaggacctgccagtcaagtcaaagagtggcagtgctctggaaatgggacttttcgaggagctccaaaccctctctcttcttgcaagcctgctggttttcaaagcctttgtgtctgcaaagctcttgatattcatggctgttttagagctgggaagagtaggatggaagtcatttaagttataaagctacaaaccctgctgatccgtgatttggcatgtttctgtttgtttccttattttctagtaaatgctcttctggttactgcaagcctttgatttttgaaattttttgccagtctttttgttgcctttatggaggaatgatttatgagacccccactccaccatattggaaatcttgcaaattcaatttctttgaatagaaaatagtattaatagatatagggcaatccaggctatctacttcttctcaagggagctttaatagtctggaaaatttgctcatttcatttacgttattaaatttattggcataacattgtttataatattccctcactaccctttacaaattatttaaaaaagagatgtcatctcttttttttcctgattagtctggctaaagatttatcaattttattgattttgtgaaagaatctgcttttggtatctttgatttttcttcattgttcttctgttttctatttcattgatttcctctctgatccatattactattttcttcttacttctgttatattaattatgttttttattttctgtatcttaccatattttgacattctggaagatgtttcatatctagggagagactgctccaccaggggctaagcagttcctaggtgtgttgtggacagcttacagcttgcccttcatgtgagactgcttgacccaagatggtaccccactcacctccttatccaactctcacacacccaaaccaatgttaccccagcctcaatcaacacagggctaggtaccagagaactagggacagcctctatgcccaaagcctgcaaaaatggttcaaatgggccaatctgaaactgtttatgctgccctgccttgcctttcccatgggaaccccagtaaagatgctggcctaggctttccttttgtttctgcttctgcctcctaacccaatctggtgattctccctgtggttttgcgtggtatggcacaccccttctgtccgaaccactaagtaatacaaatctttcaattgcattagtctctgttttgtcactcagtcaccttcgtaaatgaagacccaggcatagaatctctgcttgctgcttactttggaattactttgttctttttctagtttcttaaggtagaagctcaagtcatcaatttgaaatttttaaaaaatatataggcatttaaggctagcagtttccctctaagtactgctttcattgaatgccataagttttgatatgttatgttttccttatcattcagatacaaatactttatattctttttgatttctttgactcatgagttatttaggagtatgttaattttcaaatatatagggattccttggatatctttctattattgatttctaatctaattccattgtcaccagagaataagttttgtctaatttgaatccttttaaatttactgagtcttgggttatggggaagaatatggaaaatttgctaagttttatgtgtgcactttaaaaagaatgtaatgttctactgttgttggttggaattttctgcaaatatcaattatgtcaaattggttgatagtgttgttcaaatcttctatgttgttactgattatccgtttaattttattgcttgttctatcggtccttgtgagtggggtttctctagtttcttgcagaaccagtttctctagttcttgcagttctgtcagtttttgcttcatgtattttgaagcactgttagcagctacataaacatttggtattattgtgttcctgttgattaatgacttctttatttttttaaaatttatttatttatttattcattcatttttgggacaaaagtctctctgtgtcacccaggctggagtgcagtggtgcgatctcggctcacagcaacctctgcctactgggttcaagtgattcttgtgcctcagcctcccaagtagctaggattatgggtgcccaccaccacacctggctgattttttttgtattttagtagaggtggagtttcaccatgttggccaggctggtctcaaactcctgacctcaggtgactcacccgcctcagccttgcaaagtgctgggattacaggcatgagccaccacgcctggctgacttctttatttttatgaaatgccccttttttcttgtaatatttttactgtaaaatctactttgataataatagtcactcaagctttaactaattaatttttattaaggtatagttgacaaaatcgtgtatatttacagtgtacaatgtgatgttttggtatatgtatacattgtgaaatggttaaccctagctaattaatcaaactttcttttcatgagtgttagcctggcaaatatttttcttttctttttaatctatttttacctttatttataaaatgtctgtatgtaggtgtatgtgtttatgttaggcaccacatagttgggcctttctttagccaatctgatcatttccgcctttcaatgagagtgtttagactatttgaaattttagtgtgattattcatatattagggtttaattctgggatcttgctatttgtttttctatttgtcccatcaattctgttatttttttctctttttttgctgccttttagattaattggcatttttaggattcattttattttgctttttggctttttagtcataactgtttgttgtgtatgtgtttttttaatgactgctctggggcttaaatagccatctctaagttatctctgtctgccttcaggtaacactatacagtttcacatatagtatacaaagttaagagtatatacccatttctcctttcttgaactttgccctattatttccatatatgttacttctttatttgttttaaactttatagcattttattattttttatttaaacactcagttttctttaaagagatttaaataataagaaagatgatcttataattacccatttttgttgctattcattcttttgcgtagattcattttcatcttataatattgtgctttttgaaggaattaaatatttcttgtaatgcaggtctactggtgatgacattttacagctttggcaaatctgaaaaagtcagtattttttcctaaattttaaatatattttcatgggatatggaattctaggtagactttttctttcagtactttaacgatattgttttgctctcttctggcttgtattgtttttggaaagaaagctgcatcattttttgtctttgtcctctgcaataattgtgtcatttctcccgggctacatagaagattttatctttgtcactggttttaaacaattttattattatgtgtttgtagtttgctttatgtttcttttgcttggggttcattgtgatatgggggcctatgtatacatcatttttgtcacatcttgaaaaacttcaaatatgttttctgttttccacatttttcttcttcagtgattcatattacatgtattgaagttgtcctaagtaaaataattccctgcccattttattctgttatttttgtctctgtgcttaattttggataatttctaatgctgtgtcttcaagttcactcatctttttttttcctgcagtatcaaatctgccgtgaatcccatccattgttttttgtaactcaacattattgttttcatctctaaaagttttttaaaatctctttcatgtcttcactaatcatgtttgatctttcctgtagcatcttgaataaatggaatacaatagtaataaactattttaatttttaaatttattaggcctattgtctgtgtcatttctgggtcagttttgactgatcgatttttttcctccttatcgttggttgtatgttactgcttctttgcatgcctaattatttttttggatgttagacattgtggattttaccatgttgggtgctggatattttcgtattccccagaatgttcttgagctttgttctgccacatgattgttacttggaaatggtttaatcctttcgggtcttgcttttaagcttaattaggatcaggaaaaagtttattcttggcctaattttccctaatgactgagtcagaacccttctgggtactctgcctgatgccttatcattaatgaggctttccaccctggctgttgggaacagcaactgtttccagcattgggtgtgctccatgtgttactccctccagttcgtttggtagtcctccctctagccttgggtcattttcttatatgcttacactgactgatactcagctgaaaacttgggggagactctcagttatcccaagactctttctgcgtgtcgttatgcagctctaagtacttgggtactctgccctgcaaacttttctacccaggttctcagctccatctcctcaactcactgggctttgcctgtgttttttctcggcaatgtcatggcctagctgtaattttggacacctcctttcttctccgtctttctgggatttctctcctttgttttctgatgttcaatgtcttgaatactgttgtttcatatattttgtccattttttagttgttcatgtgggaaggtaaatccagtttctattactccatcttgtactgaaaggcatgtctctcctcctacattgtccccactttttagatgagtgaaaagggggtgaaggatgttaaataacttgccaggggtacagcacacaggcagtaagtgatgcagctggacttgaatatgcttctcagactccccagataatgatcttatcacaaggctgtaaagcttttatatgtaatgtgaattgatgtatttaataatcaatgtgtttcttcgtagatattaaatcaagacacactggcagatttttatgtaaattgcttccacccttcttccttttaaagataaatgcaaggaacgtgaagaaaaaataattttagtgtcatctgcaaatgaaattgatgttcgtccctgtcctcttaacccaaatgaacacaaaggcactataacttggtataaagatgacagcaagacacctgtatctacagaacaagcctccaggattcatcaacacaaagagaaactttggtttgttcctgctaaggtggaggattcaggacattactattgcgtggtaaggtaagagaggaattagtatgttacaaacatgttctagtttcctgcagttgttaaggacagaaatacttttaataatgcttaacttacctattttattttattttagaaattcatcttactgcctcagaattaaaataagtgcaaaatttgtggagaatgagcctaacttatgttataatgcacaagccatatttaagcagaaactacccgttgcaggagacggaggacttgtgtgcccttatatggagttttttaaaaatgaaaataatgagttacctaaattacagtggtataaggtaattttattttaaatatgacatttcacttttccagaaaataaaatagttccctggacaatagaatgtatctgcaaagtacctttttattttgtatattgttttctctttaatggtgaaacttgatagggaacctaaaaagaattgtaagactgcattcacttaatttgaagcttaactagaaatttgtttgctgttgtttttatttaatttaataagatgtaattgagaaaagtactagaaatagatgtttaaagagaaggctgattataagcttaaggtattgaagatgtaactatttattacaaaacatactatgtgtgttttattgaagatatggtcttcaaataacctgctagtttccataactgtctgaaaagtgggttgactagctttccatggaacaccccatgttttggtaactttaatctacctagtctgatggaacttaaatggggaatcatcttgtagagcttaagacgtactaaatacgtaatatcaatgaagtgcagtattgttaagaaactatatagtgttaacatttttttcaaacatgtttttcttgcaaaataaattggccttcacttcatagtacaagtctcatagacttgaaaacttaatgtcataggaatatagttaactgtttccaaaaagccagtattaaaacttactatatgtaaggaacttttccagtcactttctaaaaatataacatttgctaaggtgaaaaaaatggagctcctttggcggtagattggggaaagttattggttattggttttcaatgcttctctctccctttatctaggattgcaaacctctacttcttgacaatatacactttagtggagtcaaagataggctcatcgtgatgaatgtggctgaaaagcatagagggaactatacttgtcatgcatcctacacatacttgggcaagcaatatcctattacccgggtaatagaatttattactctaggtgagtcatagctccagccctaaaaggtttagatctgggaaggtccagagactgtgattctaatactactttcattatccatgaagaaaccaaatccaagacgacctcaatgataccacaaaagtcacatggctttagttttgtttttttgttactaaatactatgtaatgtttttccattcctgcttcagatgtagttctaattaaatagagacattatgagctgtgttttccaactgatttaagagggttgttctttggcatggctaaaaatggttcttactgaaagctctggggctccctctggctggtatatgggaatgttctgagagcctgcacctggggaatctcagtgagtgtcagtgtctagcagcaagcatcggtgtggacactaatgagctttggaataagtcacatttccagaatctacctcctgttcattctgtgttaggtgttaacctctctaaccctgtttcctcttctgtaacaagatgatgcaatctcccaaggttattgggaagattagagatatggggtacacgaaacttgtgtacctggtgcaaagaaatgcttggtgcaaaacagctatgcaattaataggtgtaggatgattgttcttgttaattttcttgtgtctttcaattctgcgttaaccatgtttcatattgaaaactatatcacagcaaaatgaaacaaaatgcacaaattgccaggggatagtcagaatgctcaaactttttgtaaatattgagattttgtaagatttatgtaataaaataagagttattccaatcagaacttttttgcaggttataggggtgactattagtagttatgctgggacaacaggtataaattgggactatcccaagcaaactcagaatatgatcaccctataaatagcttcacttttccagttatataatactttattttcctaaaaatatttttattaaataaaagttaattccttgccatggtcccacaggcatcagtgaatcccaattttcaatggtctttgtatcaaaccatgttcttgagtttttagcagcctgtcattgggtagctctggtctgtctttcctgaaacatagtaacctaaccagcaagtagaacttgagagagaactgggcactggggactatttaagctaggttaagtgtttttttttttttttttttttttgagatggagtctcgctctgtcacccaggctggagtgcagtggtgcgatctccgctcactgcaagctctgcctcccgggttcatgccattcttctgcctcagcctcccgagtagctggaactacaggcgcccgccaccacgcccggctaatttttttgtatttttagtagagatggggtttcaccgtgttagccaggatggtctcgatctcctgacctcgtgatccgcccacctctgcctccttaagtgctgggattacaggtgtgagccaccgcgcccggccaggttaagtgtgtttttgatattctctgtttccttttctgatcccatttgtagaaacaatatactctactcggagtgaggtaatattttgttttctttccaaggcccacaccaatgatgcctagcactttttgttcactcaaggattcaaaaatatttattgagcatttactatgtttcaggaactgtaataggtatacattagggaaaaaaacagagaatatcctaccttcatggtgttcactttttttttgattgggggaataccgagtgctcaattttatagtttctcatagtttcttcatggccacagataaacccctgaaaccaatcttttcataaataagtcagattaatttctggggcttcttgatacttttttgcctattttaataaattacagcattattccataaccctgtagttctcactattgggtcattaacacagtcattaaatgcaagcaggtctagtattgactagcccttctggccaataacacccaattcaaggaagtgactttccactactctcgcctttgctgacatgctttcacttaagagaggcatttgtctggggacccagggtcctggtgatgtgtgtgtttttcagtagcaccccactctatgaattcggaaggtctagctctaccccgggattcacagtgtgctgtggcctctgcctcagctttcttccttcactttctgcctcctgtctcctggcatatgtgctttgaacacttgatggaatatctggccagaagtcatttagtatgttttgctaagtgttgtcgtcacttgagattctgatctataagagactgacaaaccttatggatgtttttctttcagaggaaaacaaacccacaaggcctgtgattgtgagcccagctaatgagacaatggaagtagacttgggtaagtgggcttcagtgagggtatgctggaatcggttttttttttttaaaacataagagtaagataaattgtatctttactatatataatctaagccatttactgtataaatctatcaatggagggaaagtgagacaaattatatcttaattttttgtatttcttgcctctatggcaaacatcttgccatgtctgatatctccagccctacttttctgtgaacacttattaccatgaaaacaccaaccagacaccaaggtcaaaaggcctaggaaccagcaatgccattgactggtacaggattggatttctttctttttttttttttcacagagttaaaatatttaatgacaaaaatagggtttgctgtaaaagtgaatcaatacagtaggtgttacttatctctgaattaaacaaaaattatatttgacatcttaaagaacttctgaagaattgatcattgtacgacagacatcagcagtgttacaatttcaggactggatttctcatgaccagatccaagctttgagtcggaagagtaaggctacaggccccaaagatggtagtcattctagaaaagtatttttccaagttagtgaacattttttattcaagagtaaagaaagaaccccacaagcatctagctctgcactgtttagtgcagtagttactaggcgcatggagttatggacatgtacaattaaattaagtcaattgattcatttagttaaattaaaaattagttcctctgtcacattagccatatttcaagggcttaatagccacatgtgacaagtgactactgtacagacaagcacaaatatagaacatttccaacatcactgaaagttctattggaaaccactgatcaagagagaaaaagtggttctttgtgtcagaggacccaaaataggttggccttggaattgtcctctgtaatagtaactgcatgacagcagtcaagaaccatacagaggttagaaggtatatgcttgtgatctgtgaattctgtacttggccaattctgtacttgttatttatggtggaaggtggtagaaagacattcttagacagaaacaaaaatgtcaaaactcaaaattaaatatgggccaataggctctagaacaatgtttctcaaccatctttttttgttttaaattgttcccctttagagtctaaaaagtcttcttccacctaattctctttcctgtctttaaatttcagtaccacagttatcttttatatttgctgatatactgtggccctttggagtaccacaaaccatgtaatatctaaggttttcttgcctcttccccaagaaccagtttttgccctgctggccacagcccctgttgaaaatgcctgccctagaagtgtgtaattgagagctctgatgcctaggctgcattgatctctcaatctacaaaaaaaagcttcaaattaggaaataattattttaatgtattatattgacagtggatcagaagcatatagtaccctgtcataggattatcctgaagggtgttaaacaggcaataagatccaataccattactcctaaaatgacttagaaaaatagggattgagagatatttccttaacttaataaataacatcagtgcaagccaatagtcactaatattcttcatggtgaaatactatagaccttctcactaaagccaagagcaagacaaagatgcccatgtaaccactattactgagcacagtctagaagtgcctactaatgcaattgaaggaaaaaaacaaggtatgcttaccacaagggaaaaaagacatttttattattgtttcctgatcataccaatcccaagaaaattcccgggaaaaactagaattaattctgtataaattagtcagataataaattaacatttagaattaatgttctaaaatataagacttgtttagcaataaccagctagaaaacataataggaaacaaatgccatttgcaccagtaaatgtcttagaagtgtccataaaatatgttagaaaaactttgaaaatatgtggaatttataagagaggaaaaaactaaaaaaaccaaaaccctgaatattaatctcagaaaaactgaaatttaaagcatgcatccagccaggcgtggtggctcaagcctgtaattccagcactttggtaggccaaggtggacagatcacttgaggccaggtgtttgagaccagcctggccaagatgttgaaacaccatctctactaaaaatacaaaaattagctgggtgtggtggtgcacacctgtagttccagctgctcaagaggctgaggcatgagagtcacttgaacccaggaggagaaggttacagtgagccgagattgtgccactgcacttccagcctgagtgacagagcgagactgtgtctcatttttaaaaatggaattaaataatggatagagggataacagtttttaaaaaggaaggccgatgagcaccaagctaatgaaaagcatgttgattcaccgtgaattcaagaaatgtagatgaaaacttaagtgacattttcttctctcaaaaggcaatgtctaaccaaaaacacttgttatctggtggttttggggaaaatcgtgctcacatacactattggagagagggtagactgacacagcctcactaaagagagggggttagcttttaaaatatgtttctttaattcaatcttgcttctagattttaatacttcaggatgtgtacaaataaggctattcattaaaatattaatcataatagtgaaaaattaggaaattgtgttcatcaataggaaatagttaatcatagtgtatatgtattatggaatgctaagcagccatgacagagtctattttggaagacaaatcatgtgggcccaaattcccaatccacagtaattacaaaatagtaggcaaaaagaccccatttcaaaaactgcacatgttcacagagaagataaggaatgagacgcataaggttactaatggtggttttctctgggtggtgggtttagggtaattttcctttttctttgtgcatttctatatctaaaattttaattcaatagccatttattaatctagatagatcagaaaaaatcaattaatgttaagattaaaaatacattctttgcaggatcccagatacaattgatctgtaatgtcaccggccagttgagtgacattgcttactggaagtggaatgggtcagtaattgatgaagatgacccagtgctaggggaagactattacaggtatgtatgctaagagttattcacattttggtgttaaatcccacgtgatattttatataaccttgtcggttcagtttaaaagcaagtgttagttgctcctaacctttgctgcctttttttttttttttttttttttttgctaagctaagtagaatttataagatcttgtacatttaaggtaaaaaatacttgtcattgtggtgcaaattacagaccacttagaagcctttctcttacgttatacatgttgcaacatttcaacgaagcaattatctttcattattcttcatattcctcaagtagcttagaagagactcattaatgagctcaagaatcaggcaatccactgctctcgaaagcctctactggtttcctactgctcatctatgggacaaggatctcctggcttcccatgacctctccttcacaacacctgcaaagcactttgtcatctgccccaatctcctcttgtttagtgtctcctctgtgccccatggagaacacaatgcatttgtctacatttttcttcttggaagtggtaatttttttgctttctctgctactgagcctgttactgacagtggtcttggggttataaaatctcagattagtgttgccagcagtctgaatgttgtgactgtgattgggcagggtgattatttcagtggcaattttgtcacaaataaggaaatacacagggtatacaggtcttatttgtagttgatgcaattaacttacacaagtttatttactctctctctcgaatagtgtggaaaatcctgcaaacaaaagaaggagtaccctcatcacagtgcttaatatatcggaaattgaaagtagattttataaacatccatttacctgttttgccaagaatacacatggtatagatgcagcatatatccagttaatatatccaggtaaacaacaaactaattgaaatgcagttttgttttactgtagtaagattccatgactttgaagtttgaaatgccatttcctctgcttagaacacgcttcacttcctcattacttgggtaacttctatttctcttttactcttctgctgaactctctcttcttggaagcttttctgtcctgctgcctgcccttaacccagctctcggcccaaagagaggaggttagggcctctgtatgtacttctgtagcaccatatgtcacaggatctatggtacttcgttttctgtacttaactataaattctgtgatggtggcaaccatttatcttagtaatcattctatttccacagctaatggcaagttaggtctggtacattgtgggtacccaatgaactacattgatgatgcatagggtaagactaaatatccactttcaaagaggacatcagaagtcactgggtttcatgaattggtataataaaacataatattgaaagtatttgtgaaacattttaaggtaatttgtggtttaattaaacataggctattataattgcgtgcatggaagaatatctgaaagactctataaattaacttctatgtatgtttaaatactggcagcatacaaatagaaattacatttaaaagataacatttatggtagcatcaaaaatcatcaaatacttaagaataaatctagcaaaagctgttcaaaacctctgtaatacaaactaaaaaatattgagataaattagagaagaactaaatggaaggatatacaatgttcatagattgaaagactcgatattatgaagatatcagttcttccccaaatgaatctatggattccaaaaaatttcaatcaaaatctcagcagtatttgtacaagtgagagtcagtgtttgtatgggtgtgtttttgtggacacctgtaaaagtcatagggaactgtaaaggaccaagtatagtcatggtggtcttaaataagaaaaataaatctggaggattattactacagacatcatgatcttgtatgaagcgacagtacttaagaccgtaagtgtgaactatcatttgggccagctggatatttgtctggaaaatggtataacttgatttctgttttatatccaaatcatttaaattggaaaagtaaataaagcttttagattcccttttctggatgcttttacatggttcctgatatttagagggtactttctttttcttccctctttcttcttctctagccccctccccatcacctactccatctgctccccagcttcctctttaattattggataactaagtagagaaggaggccaggagaatgtggaaatgtgaaacttccctaagcctccaccttattcgctttccaccagtctttaactttacccaatggactctctgacctcagggaacttttgtaggcttttgagtgattttaacttttccctgttttactgtggaatgctctatcctgtggtcttcggtattatttcccatgttattgtatattatgctatttaggtagaaacttcatagaatgcaccttagttttatcattgctttgtacattagtatccattacaaagtgataataatgaatgagttaatattgtctgaatgcaggccattcccagatatgggctctctgagacgaagatatttaatttgctgtgctcaaagttttaattctttttggttctaatattttttctcctttttttttctttttgctatagtcactaatttccagaagcacatgattggtatatgtgtcacgttgacagtcataattgtgtgttctgttttcatctataaaatcttcaagattgacattgtgctttggtacagggattcctgctatgattttctcccaataaaaggtataattttgtattccatgcagtatttcttgttggagataagggatagttaggagatgtagaagatgactaagagggtttttactaagagggtttctaaaatgaaaagtggcatatacaagaatactagttattcttacacagaattatagttttagaactcattaggctgaatatcattgttttctaagttcctgcctcaacattcatattggtagaataaacaggtatttagagcatctgtttataaattcagttatgcacaagccattggtaggccttgctctgtgatgaataggacagacagagatcataccttaatgaaagaaatgaaatgactagatcttcatgcatcagggaggttctctctctcctttgtttaaactttgcgaaaaaaaaaaaaggaataccacaatatctaaaaaaaaatgaatggatagaattcagggctgagacctctggggaagaagatgaggacagggagactttaaggatggctctatactaagagtatacgaggcagcctccaaatagaagaacaaatttgcagtaaaacacaagaaatagaaaccttgtaagagatgaacactttttaaagggattatatttttggtattgctgcttcagtcatgccattgtataaaaaaagatgaatagttcattatgtaatgaatgtttgtgatactgactttatcaaatctcttatttttgccttgtggttctaaatacattatgtttttcctttagcttcagatggaaagacctatgacgcatatatactgtatccaaagactgttggggaagggtctacctctgactgtgatatttttgtgtttaaagtcttgcctgaggtcttggaaaaacagtgtggatataagctgttcatttatggaagggatgactacgttggggaaggtatgtgtgtaatggaacagagtaaaggcttattgttgtaaaactacttagtaaaatgtggattccatctttctagaagatcgtggcataggggtatatgtttcacaattttaagaacctcttcagaagtgtatgatgatttttacatttattaaatgcatttacttctctcatattttgtcagagcaataattaagtgattttcatttagttttgaaaaacttaatgactagttaaacccaacagttgctttacaactgatacaattaaacaggagtggtagagatcaaatgattgaataataagtttttaaaattccaacaaagttttctgagttctaaatgaaatatttgtcttttgagggccaatttttgagttagtctataaaatgggaggtttgcagtggctcatgccttttatctcagtacaaccctgggaggccagggtgagagggtcacttgagcctaggagtttgaggctgcagtgatccaagatcacgccactgcgctccagtgtgagcaacagaacaagagactgtctcttaaaattaattaattaaaaacatgggaaactcctttaattttaagtaagacaagaaaaaggcattaggagccatacggttgtgaaaagccttgtgtggctttggttcaggagagaatgatgataaatagaattttacttactatattgtgcttcctgtttttcagacattgttgaggtcattaatgaaaacgtaaagaaaagcagaagactgattatcattttagtcagagaaacatcaggcttcagctggctgggtggttcatctgaagagcaaatagccatgtataatgctcttgttcaggatggaattaaagttgtcctgcttgagctggagaaaatccaagactatgagaaaatgccagaatcgattaaattcattaagcagaaacatggggctatccgctggtcaggggactttacacagggaccacagtctgcaaagacaaggttctggaagaatgtcaggtaccacatgccagtccagcgacggtcaccttcatctaaacaccagttactgtcaccagccactaaggagaaactgcaaagagaggctcacgtgcctctcgggtagcatggagaagttgccaagagttctttaggtgcctcctgtcttatggcgttgcaggccaggttatgcctcatgctgacttgcagagttcatggaatgtaactatatcatcctttatccctgaggtcacctggaatcagattattaagggaataagccatgacgtcaatagcagcccagggcacttcagagtagagggcttgggaagatcttttaaaaaggcagtaggcccggtgtggtggctcacgcctataatcccagcactttgggaggctgaagtgggtggatcaccagaggtcaggagttcgagaccagcccagccaacatggcaaaaccccatctctactaaaaatacaaaaatgagctaggcatggtggcacacgcctgtaatcccagctacacctgaggctgaggcaggagaattgcttgaaccggggagacggaggttgcagtgagccgagtttgggccactgcactctagcctggcaacagagcaagactccgtctcaaaaaaagggcaataaatgccctctctgaatgtttgaactgccaagaaaaggcatggagacagcgaactagaagaaagggcaagaaggaaatagccaccgtctacagatggcttagttaagtcatccacagcccaagggcggggctatgccttgtctggggaccctgtagagtcactgaccctggagcggctctcctgagaggtgctgcaggcaaagtgagactgacacctcactgaggaagggagacatattcttggagaactttccatctgcttgtattttccatacacatccccagccagaagttagtgtccgaagaccgaattttattttacagagcttgaaaactcacttcaatgaacaaagggattctccaggattccaaagttttgaagtcatcttagctttccacaggagggagagaacttaaaaaagcaacagtagcagggaattgatccacttcttaatgctttcctccctggcatgaccatcctgtcctttgttattatcctgcattttacgtctttggaggaacagctccctagtggcttcctccgtctgcaatgtcccttgcacagcccacacatgaaccatccttcccatgatgccgctcttctgtcatcccgctcctgctgaaacacctcccaggggctccacctgttcaggagctgaagcccatgctttcccaccagcatgtcactcccagaccacctccctgccctgtcctccagcttcccctcgctgtcctgctgtgtgaattcccaggttggcctggtggccatgtcgcctgcccccagcactcctctgtctctgctcttgcctgcacccttcctcctcctttgcctaggaggccttctcgcattttctctagctgatcagaattttaccaaaattcagaacatcctccaattccacagtctctgggagactttccctaagaggcgacttcctctccagccttctctctctggtcaggcccactgcagagatggtggtgagcacatctgggaggctggtctccctccagctggaattgctgctctctgagggagaggctgtggtggctgtctctgtccctcactgccttccaggagcaatttgcacatgtaacatagatttatgtaatgctttatgtttaaaaacattccccaattatcttatttaatttttgcaattattctaattttatatatagagaaagtgacctattttttaaaaaaatcacactctaagttctattgaacctaggacttgagcctccatttctggcttctagtctggtgttctgagtacttgatttcaggtcaataacggtcccccctcactccacactggcacgtttgtgagaagaaatgacattttgctaggaagtgaccgagtctaggaatgcttttattcaagacaccaaattccaaacttctaaatgttggaattttcaaaaattgtgtttagattttatgaaaaactcttctactttcatctattctttccctagaggcaaacatttcttaaaatgtttcattttcattaaaaatgaaagccaaatttatatgccaccgattgcaggacacaagcacagttttaagagttgtatgaacatggagaggacttttggtttttatatttctcgtatttaatatgggtgaacaccaacttttatttggaataataattttcctcctaaacaaaaacacattgagtttaagtctctgactcttgcctttccacctgctttctcctgggcccgctttgcctgcttgaaggaacagtgctgttctggagctgctgttccaacagacagggcctagctttcatttgacacacagactacagccagaagcccatggagcagggatgtcacgtcttgaaaagcctattagatgttttacaaatttaattttgcagattattttagtctgtcatccagaaaatgtgtcagcatgcatagtgctaagaaagcaagccaatttggaaacttaggttagtgacaaaattggccagagagtgggggtgatgatgaccaagaattacaagtagaatggcagctggaatttaaggagggacaagaatcaatggataagcgtgggtggaggaagatccaaacagaaaagtgcaaagttattccccatcttccaagggttgaattctggaggaagaagacacattcctagttccccgtgaacttcctttgacttattgtccccactaaaacaaaacaaaaaacttttaatgccttccacattaattagattttcttgcagtttttttatggcatttttttaaagatgccctaagtgttgaagaagagtttgcaaatgcaacaaaatatttaattaccggttgttaaaactggtttagcacaatttatattttccctctcttgcctttcttatttgcaataaaaggtattgagccattttttaaatgacatttttgataaattatgtttgtactagttgatgaaggagttttttttaacctgtttatataattttgcagcagaagccaaattttttgtatattaaagcaccaaattcatgtacagcatgcatcacggatcaatagactgtacttattttccaataaaattttcaaactttgtactgtta

SEQ ID NO: 32 - DNA, 149937 bp, Homo sapiens
agacgctgtgaagagaggagccgcggcggtcagtaccttcggtgagtttggacctcagcagccggcagtttccacaccctcccccttaaatctgtggctcagagggcagtgaaccccacttgggcttctctcaggctggaccagtgttatagccttcgtcctccctgcggtagctcagcaaacttttgaagccacgagtattctcaggctcggagctagacactgtgtgcacggttcctgcctgcaagaccctgtcagtctgaccgggcggaagccagccaggcagcaggagcacagcttagacccggccaagtcagagcagcagcgagtcagctgggaaggtgctggggctccccgctccagtgagacacctgccctgcgctcagctgggtgcgacgcttggcacgctgggccctctgcacttcggcttcctcatctccagaaagaaaggtgataatgtgacctcatggagttattattaaacaggataatacaagtaaagtgcttagcacatgcatgacacatagtaggtgcacataaatatttgtcggataataggtaaagacagtcgcatacatgtgtgctgctcagtgtgtccagtctatcatgagttgctaagggtgcgtactgatgaaaatctttgagaggagaaggctaaggaggctagggagagagagagggtgactgtagctgggctgcaataagctacagaccctctgacaagggacctttacaccagaccgaggaatctgagctcttatttgatagcagtgatgagccattagaggttttaagcaagagtgacacattaaaagctgtgttttagaaatacaagcgatagtgtagaaaatgggttacagaagggaagacaaagtatgacggtacagtaatggtagaggtgagacacagtgaggactggaactacagagggacagcagggacagtaggaatgaagggaggggaggaattcaaaaggcttaatcactggacaccaagtaacaggacttggaaatcatctacatgaattgggtgagaggaacggattcagagtaaatacgctgctttctcatctgtaaaataatgacagtaataataatggatagcaagactttgtctcaaaaataataataataggctgtgcgcggtggctgacgcctgtgatcccagcactttgggaggcggaggtgggtagatcacctgaggtcaggagttcgagacaagtctggccaacatggggaaacccgtctactaaaaatacaaaaattagccgggcgaggtggtgtgcgcctgtaatcgcagctactcgggaggctgaggcacgagaatcgcttgaaccagggaggtggagtttgcggtgagctgagatcgcagcactgcactccagcctgggtgacagagccagactccatctcaatacataaatacataaataaaataataatggtacctacctcatagggtcgttttgagaattgtacgataatatgtgtagaatttcttagaactgtacttgacacatagtaaacattaaaaaagacaagctattactttttttctccacagctgtatttcacattgcaaagtaaaaaccgagagtctgttttatacatcagtcactgtgaatcttaaataaccacctctggcacactgctgggattgagtgagcttgtgagcatgaggaccagaacctggactctggtgaatgaatcagagtaatgtcaccttagacagcactctgtctggcgtctagccaaccttctagcaacacactcctctgcatcaatgtgtactattattttccctttttctttatacttccttagagttgaccctgtcaacctaaataacatacagagagcggctttctaaaagaagatgatgtttattcgggagtaaggcattgcaatggaatatgcgtgccatggtaaactatatgtgtatttagggaggtaaaggaaaacaagggttttaaaggaataatgaaaaagactacataattattttgagataattatccttggctacaaagatcaacaataagtgtgatgctagtctgaggttggacaggcaattgttgggcagatgtccttgtagaagtatttttttttatgtgtaaggttgtgatggcttttgtgcaaggctgtggtctttgcagtcttttgggatagttatccagcatacaagcgtgagaacccattcttcatagccttccccagctctatttgtcagggttctttcttaacactggtgactccattctaattctgacaacttttacaactcaaaactgcacagtctatctaatgagttagttgaaagaattggctgtaggctggacgaataagcctggatctaatgaaacgaaatttatgctagtcctgcaaatagactcccaaacctagctagtttactaatagaatgtagaacatggtctagaacccaaacttcgactgccttaaaggaatacaatgaatgtccccgataggtgaattggtagttccgctcttctggaaagtgtccagatcctacgaagaacatataaaattaggaggtatatatgatgcattgggaattaacttcttgagctctcagggtggtaaagaaaagttggaaacatgtcattgaggaataattgaaataattgggatactttctctgggaaaagagaggatctggagagaaatgagagccaactacaattatttgaatggttgaagtacacagaaaaacttgttctgtgtgttctcggaagaaaaaataagggtcaaatggatccaagttgcagggaggcagatttcagcttaatataaaatatactaagaagtagagctgagcatgaacagaatgtgctcaccctcttacccgaaatatttaagttgaagctgactgacaatcttgttctttcatctattcaggaatatatcaataaattcattcctgcaaccattttacatattgactgccatgtatcattcttagagctttcctgtgttgactcagaacaaccttatccagtaggtgctgcattttaaagatggaagtactgaggcacacagccattaaatacttggttaacacctcacaaccaggaagaggatgagccaagatttaaacctagtcagactgactgtagccagtattctcatccctggccaacacactagactgcttttctgacagtgctggggtggatgttgagatgtgtgacctgcatggggtaggaagttaaactaaagtcctctttcagctctgaagattccatgattttatttattgaaccctacatgtgtcaaagagaatatctaggagtatagtaaaaacaactgccatttctgagtgcctagtaggtgttttatataaactcatgattcctaaccagttcttatgcctgattgtgtgaaagaattatctggggagtgagaccctgttaacagtacgtttttaagttttccaagtgattgcaaagtgcagtcaaagttgagaactctgtatataaaagatctcatttaatatttacaacaactctaccaaataaccctatcaccctcattttacatattaaaggatcaagaggttaaggaacttgtttcttgggcaagcagggatgtgaacccaagtctctgtggctccaaagtctccacaggttacaatgtagctttccaatccctttgttattaaaacaaaacaaacaaacaaacaaaaccccaaaaaaccaaaaataccttattctaccttaccagttatactgataatctccaggagaacaggagtctctcccacctgacctgctccactgctttttacaggttcttcagttaccttttatgacccaggaaaggtaggaatagtatttattgtccggtattgctacatcagaacaccgggcaaattccttggtttccagtattttcttccacattgtacacaacctgacattaactgggtttgtaatgtgaaagtttattacatggtagtattagccatttggggaatatattgtttaagatagcacagaataaagtgtggtgctttcgtcttgagaccaacttaccttttgttgtggttcaactcttgttttcagagtgctttagttcccataattgttttttacccaccttatgattatcttgtgaataaattatgggctctttttattagaatctatatccagttaacgttcagttatagtatgttaaaataaatttattcagaaaaaagactgaaaagtagaaagtgatctcatgaagtcatgaggcttatgatagcagggaagaaaatcatgagattcaaatcactaggtgaacttgacccattattcctggctttaaagggcaccataagtcaaggaatgcgagtggcctctggaacttagaaggactcttgggcaacagccagcaagaaagcagggaccactgttccatagccacatggggctgaattctgccagcagcttgaatgagcccagaagtagattcttcctcagagcctctgaaagtgaaggcagcactgccaacaccttagcaacctcctgaaactctaagcagagagctagctgagtcacacttgacctggacttttgactcacaaaaccatgaaataataagtggatgttatttaagctgctaaatgtctggtaatttatatggcagcaatggaaaactaaacagtacctacttacagaagaaagtgctattgaaactcacagatgaaaaattttcatttagttatcaattgattagcagcagtagaatatcagtttgattttgttggaaaacccaggaactgccttgccttcacttatttgggacctgcgtcttggaaacttagggagtactttccaatactttaaatgttgatttttatcaaagaaatcattatcgatcaatcatagtcacttcagtcacgactgtcagaccatccttgttttggtcaaactctgatggatctgaatcagtgatttagaagataagtttattctgaaactattttgaaagagaattgttgatttcttcatcttgaattatacattgaggtgagggactgtatattgctcacctttgtatcctctgcaatgcctagcataataatatgctcaatagttttaagaattaaattgacctaaattatgaaggcaagggagaaaataatatttaggtgtgtgtgtatctaaacaattttacccacagtatgtggtcatttataaccaaactctgtaataactgaattggctgcataattctttatttaaaaaaaaaaacagttactcactgtagagtaacatagaaagcaagtctgtgtatcccaaactggaaggaatagaaaatattctcagccctggccaacacactagactgcttttctgacagtgctggagtggatgttgagatgtggataactaaaaggatgacagaatgtgaattttaaaagattttgctacttacaggtttttattgtttgattcctaaccccaccccctccataaaccccaaaaggtatatattctacaattaggtggaaggaaagaggaaggaagggaaggagaaaaggaagaaaggatggagagagagaggaaggaagattcacaactaaaaaagaaaggaaaggaaaacacacacacacacacacacacacacacgtacatacactttttaaaaagtaaaacattatttttgtaacccagaagaatgcctccaaagtacaaaatacaaaatttaataacatgagtatcatgttagaccatatctttttttttttttttaattttagaagcagagtcttggtctgtcactcaggctggagtgcagtggtgctatcctagctcactgcagcctcaaactcctgggctcaagtgatcctcctgcctcagcctcctgagtagctgggactacaggcatacctcactatgcctggccatttaaaatttttttttagagacagtttggctgtgtccccacccaaatcccatcgtaattatagttcccataatccccatgtgtcatgggagggacccagtgggaggtaactgaatcatgggggcagttacctcatcctgttcttgtgatagtaagtgagttctcacaaaatctgatggttttataaggggttttcttccccttcgctctgcacttctccttgctgtcaccatgtgaagaaaagaggtgtttgcttccccttctgctatgattgtaagtgtcctgaggcctccctagccatgccaaactgtaagtcaattaaacccctttcctttataaattacccattctcaggtatgcctttgttagcagtgtgagaacaaactaatacagacagggtcttactatgtttctcatgttggtcttgaactcctggtctcaagcagtcctcctgcctcagcctgtcaaactgccaggattacaggcatgagccactgagctcggtctatatctttcttgatcatagtttataatacaaatgtttagacaatgtactgttatcccccatatcaaaagaaggcatcattatgatgtcactgcaggaaaacatggaatgaaccctagtgcccacttgaagggagacagtcatcatactacactctcctttgtcctttgatcgtgtagtgtaccatatctgctttaggcataccagtctatcttcagagaccaggaagatataacagtgtggcagtttaagtaaccctcatagcaggcttgtaaaaagttttttcttcattcccattacagttggggaattcatataaagtttagttagctagttatatgtcagtactgggattcaaaccctaatctaactataaatctgatccaaatagaactagtgttccattctgcttgccaggcatatcgtagaagaatgttgaggaaacatagggtgtttagtatagagaagtgaagacttagaaggaaggtgttttcaaatatatgaaaagctgcattatagacagagggcagagaaaacctgttgtgtcgctcccctctttaaaaccctttaatggttttcagttgtcaaggaaataaggtataaacttcttagcaaagcttagagacaactttatgatatggtacccaccttctcttcaatatccattttactctcccactctggccaatagactgcttgcagccctttaaagatgcagccctctttgatgtgcctaatgtatctttcacattctttgcctggccaactcctgaccatcatccatgtctcaaacacctcttctctaaccccccatcatgttttaggcttcttgctatacatgcccacagtaccattttcctttttgtagcactcattatttttaattgcttgtttaatatctatctttataaacaagctccataaagttagggaccatatttctcttctccaggtttgtaatttagtacccaacataagacttgatacactgcaggtgtgctcaaaaaatattttaaaaactgaaattgattagtaactccaagggaatttgaaaatagagaaagagggagggatggaccaaaggtaggatggcagaaagttaattttaatggtgaagcatctggggaaaagatgaactttggtagtggacctctggaaaaccaaagtgcaccacaatgacaatttacctagagaaagagaatctgtgattataattagctgtcttgcagaggtcagaggtctctggtggtagttgcaccctcctactggtgggtcatcctggatcctgtgcaaacaaggattattgacacacatggtgtttggtgctaatgaaatatgttagggggaaatctgttagtttcaattttacagctttatccatatctcatccccattttgtacttacagaggaaatgaaggaaccagatgatcaggatactgatggggagaaatcagttacatcaaagagtgatgggaagaagtctctgaggtcttctaaatcagaatcaagatgtaagtaaagataatatgtatacttttaaaagtattaaacttaggtaaacatttaaataattaatttttatagtagaatggaaagagcaggatgttataaaatagatctttttttttttttttttttttttttttgagatggagttttgctcttgttgcccaggctatagtgcaatggtacgatcttggcttactataacctccgtcttctgggttcaagtgattctcctgcctcagcctcctgagtagctgggattacaggtgcctgctaccacacccagccaatttttgtatttttagtagagatggggtttcatcatattggtcaggctggtctcgaactcctgacctcaggtgatccacctgcctctgcctcccaaagtgctgggattacaggcatgagccaccatgctgggccaaaatagatcttatactccctgttcccagaaagctgtaggaaggtgggctccataaaaatgatggagttagcaaagaaaaaggactacatatggtccaggaaataggagattcaaaatagaaataaggtaaaggtaatgcctaggatgacacttgggcagccatgcagagaacaattatactgaagcaaggaaaggagaattttcacctccaagaaagttaaaaatgttaaataatagattatctgatagatgcatgtagaaaattgaactgagtggaatttatagaactatgacaagatgtgggaatatttatcaggagattccagaaagttaaaaagtgaaaataaatgaggtattagttttagaaaagcgagttgttcaagaaggaaataaaataatacattcttaactcaggaatgagtgttattaaggcagtatactaaaaatagtaagcatggacttcactatagtttttttgtgctttgattatattgcaagggcggagagatagcaagtggtgatagagatttaacattcttcatcttcccataataaacactgtctaaaagtagctagagagagcagtatatccatattgtttagatatatggaggtaaatatcagaagaaaaaagattaaaagctaaaagtgattcttctggagagatagagaaggctgttaagcagggaaaagttgagtattttaaaagacaagtcttttagcattacttgactttttaagttatgggcatgtacttcaacaaaactaaaaataattttctaaaagtcaaaaaaatgggcaaaataatttttaaatagtgcatatctgggtttatagaacagaaatggtttacttgttcaactcccttacaaagctctaagttccttaagagctgtctgtgttttacttatttatcacagctcctggcacacaagttgataataacctatccacacgtctggtctagagttctcctgtgagagctactaagtcttatatggacttttctgatacaatgtagtggaaagagacctggactttggttttgagtcctggatctaccatttagagatgcttgatcttggaaacattaccacatctttctgagcctcaattttctcacccattaaaacaattatgagtcatttgggaattaaattgcataacatgtggaaggacttcataggctgcaatggaagaaaaaaggaggaattttataactaggatttttgaaagatggctggctctttctgactgactatcacgatgttaggtatcttagtggaatcttgactatttaaggttctaatcctaaatatgatttgagaaatttaattttgactgttcacctagagaagatcaggtcctgggaaaatcaatacacatgcaaaatttgcattaaattcttttaatctatcgcagacatgtcttgtaaatccacagtttctccacattatattttattttaggcatttgtcttctctggtttagactcttgcaacatggatttctacctcagtcttcctgtccagatctccctccacaccaccactagagttctttccaaaaagtatcattatatcgcttacttcagaaactttagtttgttcccccctagtttttcctttttcatgtttctgtactccctacatttctgacacaggattgtctgtgtgttggtttccagtcctcggcagtgttttcctggatgctactctcaactttcccttgatggatttaatgataatgaccctttgtctagcattgccttcaggacctgccttccttatgtcagatgctgttaggcgcagaccttttcaagtgtgacctggcccagtgctcagctcattaattagttcacatatcatatgtcttagactcccaaatgataatgtgaaataattttctggcattctgaacatcctgtaccttgttgctgcgtgaagaggtctcttcctcctggctcagcctcatacctgatcatagctgcattccccccacccctgaaaaccttgctttgctctcaggcttgttagcacatccagcaagtttttactctgggattctcatgtagaatgaataaaagtccttgtattccacccaagcagagaagttggagtagactttttcccatacttaacaagaggtttctgctatctctgagttctattaagaaatttaggtcgagtgtaccagctaaaccatccatcatttctcacgatggtgaaggactgttagttactaaggcattgatttcttatgcttatcaaaggactaaattattgcagaccttatttaataattttgggaggtattttgttcttttctattttcaaaaatattttgtgtagaattggtattatttcttccttaaatgcttggtagaatttaccagtaaagctgtctgggcctggaattttcttgatgagtgggaaaattttaaccatgaattcagttttttaaatagagggctctctatttcttctttactaagttttgcaagttcgtatctttcatgcaatttgcccacttctcttctcaattgtcaaatttgttgacataactttgtaggatctgttttcattcttgatgttgcagatttatgttgtttctcttttatttcttcattggtgtagctaggagcttatcaatgttgttgatcttttcaaagactgattttggctttgctaatttactttgttttttttttttttttcatttatttttccagcttcttgaggtggaactttaggtcattgattttttttgacttttgttcttttcttacatatgtattgaaagctataaatttccttccaaggactgctttagctatatctcaattttaatatgttgtattttaataaattttaatttgaaaacttttctaatttctttgttgatttccctttgacccatgcattatttttattgtgtaatttaatttccaaatattggactttttttcaaggtatcttatcattattggtttctaacttacctctgttgttttcagagaacatatctattctatatgatttcaatccatttaaatgtattaaaactggtcttatgtcccagcaagtgatctgtcttggtaaatgacccatgtatgcttgaatgtgtatcctgtattgataggtgtaagtgttttataaatgtcaggtcaggatggttgatagtgatgttcagatcatctatgtctttactaagtttttgactagttgttctatcaattgctgaaagatacgtgttactataataaatggtaactcttaagtagactgtagaaagttgttatatattgtaatctctgaagcaaccactaataaaacacagaattgctaaaaagccaacagaaatttaaatagaattctaaagagtaaataatctaaaagaaaacatggaaagagaaaaagagggaaaaaggacaggtaggaggagaaaaacagaaaataacttatcaaatattatttgttaatttcacaagcatatgttattaaaatctaaccatatcaataattacattaattattagttaactgaacattaatataaaaaggcagagattatcagcatggctaataaaaacaagaaccaactatatgatgctcatagaaaacacgtgttaagcataatgatacaaataggttgaaagtaaatggatagaaaaagatacatcatgcaaacagtaagcataacacggctggagtggctatattaataccagataaaatagacttcaaggcaaagagtactaccagtgacataagggtaaaaggatcaatttattcataaagataaaaggatcaattaagaaaacataataatcataaatgtgtattcacctagtaacagcatcataatacacaaagcaaaaatagaattaaagaaaaactaagtaattccacaatcatagtaagaaagcagcttagtactagttacttcataatagccaaagtatacatgcctaccattaatatttgtatattgttgttgtatgcagtaaccatgctgaactctttttaaaattataataaattataatttagttcttataaattttttataaagtagctcttacggatttttctgtatgtgcaaccatagcatttgtaggctttcttatagtgttctcaatctcatggaaaaggtagaggtaaataaggatcacagaggcaaactgtttgcgggaagcagtatctctcagatagctggagaggagaggtcccaaagcttcctacatccattggctggaggaaacaaacaaaaaaaatggaagaaacttgtatataaaattgtgggtcatacaccaaaaatcccagcaggttatttttgatatctacagttatggcattcctttctccttggtcaccttcctttgcttcctcctgcacccatccttgttcagtctccactaattttgccagcccttttgccagcagccctgccatccatttgtgatttcaggttttaactgcttctagttatacaaaaaaatggagtttgtgtttttggtatttattctcaatgttgattttagattatttccaagaatagaaaggcaaatactgatttattcttcaaaccataagtcttccatctgtctattttaggattataaaaactagagaaatatccagccttcacaaagttgcctaagtgtgttgatttgccagcttgatttaatgtgcctacttcctgccaaattagttttcttcccctaactctagttttccgtctgtagcacaacccttctccaggctcagaatacccattattttttattacgtcttctccttcatctgtattcactcgcaattcattaatctgtgatcaccttatctaccagttctaactcctttcctggggaacccagcagttaggagtgttacacttgtagtgccctaatcttgaaatgaggaaatagtctttggttgctacagtcacaagaaagagctaaggtattattagagagtagttctccagggccccctcttggggaatctgtttggcctatttaggcacccaggattactttcttgccatccaaatacacgcatcctaaggaactctgccctgttccgcaactaattggcttggcccagcttttctatcttactcatattagtcttgggctttgttcctaatcttttagcctcatctcagatctactatgtagctctggtacctagtagtacatttgccatttcttccttattcttctgaaagttcacctagctctatatgaaagtatacccatcctgcttggcattgtatattttaaccatcctcatgtttgcacttgatctgaatgttggcttatacctggggccattttactcctataccagttctcattcccagcttgtcctaaagccaatattccaacttattcctgggatatcacttccaagagaaatcagcatactcagagaaagaaagacaataaggcttgtttgtctttaacgtaacaggttccctataaaagttagtaaaattgaatttagttgaaattatgatagcagcatactaacctctttctttttatcttttacttcttgtaagtatttaatgataggaaatagactgaaaatgaagtgaaaatggagattaacaaacagaaaaggctttcttattttgtaaagttacaagactgaccaaataaaatgattcttctagaaatttttgagtatgtattagatttattacatctatagcacaaggaaattggaagttttagctactttagaaataagaaaatgtttaatcaaaatttagaagttattaaaacaaattttaatagctcctgttcaagaagataacacatttttagaagatgacacagatgaaacatttaccaaaggggaaggatcatatttagaagaagactcagatgaggaacgtttggaaggaagtttgagttcatttcagtatggtgatttgcaaagcactacaggtaggtattattagttttctgtcagtaattgtcactgttttagagacaaagcccagacaaatggaagagttataaatccatagaaagaaaaatgtgcaggatgtacatatgtgtgggaatgataaaaggacaagtacatattttggtagggtactttagcagccctagacttgtggtttttatttctgaggatcacatagagtactctgatactcattcttctgggttttaagaaggtataaaaactgctccactacagattagtgggagttcaactttcctttggaagtaattgggagttccccttggagactgttgcgccatgaccgaccagaactcagcatttactcctgatgcacgtgggcataatggctcttccttccatgctcaccgatgactgcttcctatcttccagccagtagtagtacttactgctagagtattgcaggctgtgtacattcctcctgtctctgggaaatacaattttggattcaccagacactctttgtattagtccgttctcatgctgctaataaacacatacctgagactgggtaatttataaaggaaagaggtttacttgactcacagttctgcatggctggggaggcctcaggaaacttacaattatggcagaaagggaagcaaacatgtccttcttcacataatggcaggaaggagaagtgcagagcgaaggagggaaatgtcccttatacaacatcagatcttgtgagaactcatacaccatcatgagaacagcatggaggtaacagcccctgtgattcaattacctcctaccaggtctctcccatgacatgtggagattatgggaactacaattcaagttgagatttgggtggggacacagccaaaccatatcactcttcttaaattattttatttttttagtacctcagcaaacccctgctccagctgtggaagaagcagaggaggaagttaagaagaaaatatcagagagcttcttctatgattatatggagcttgcttcgatgccttttgtgactctggattcaaacataccactggatcttctcacacttgtgtatccaccctggctaaatatgtataattttgggattttcatttcttaggtcagaggtcagcaaactatagcccagggagcccaaatgtgccttcccacctgttttggtaaatcaagttttattgcaacacagccacatccatttgcttacattttgtttattatggctgccatcacacaacaaggacagggataagtagttgtgacagagaccatctggctcacaaggcaaaaactatttactaccttccctttataaaaaaatgtgtgccaacccatattaggtaattctaagaagcttgaattcttagagatttgatagaaatgcatgatcttaatttaaactaagcttttgtttgatgccaaataaccatacagagaaatattttttctggctgtcctttgcacaagtggaaaggctgcagttcatgagatctgagtgaaggaaatcagaaggcttcttcttcccatttacttttgtcagtgcctgtcaagttacataatcaatttcccttcttgaaacacttatgtgtctgtccattgtaaggcattagtactttcacattatatatcagatgagctatcagagaagacaattcttaggaaacagggcacaaaatataaagttttaattggtttggagaataagagtcttttaagatatgtagaaacaggatgattgacaaggggattttgtgttcgtcatcacattatgatgttaggtttgcaatgcgggtagttagaaaacagttttcattgaggtccttagctggcaatgtactgtgcttcccttttggatagttagtacttatcaccacgtggcctaaaccaccaactggcctcttacataaggaatacttacagagatagggtggtgtactccctgactcagttttgctttttacataaaaacataaaaatagaacatgttgttaaatcccaggtgtaactaaattaattcgtgctgatttatcttgtaacctggaattttctctcttcatggctttttttttccttatctttggacaagtttctgacaaaagttatgctgtttgctttcttttagcctttttttcccaaatgggatggggtggtatattagagtcccctggaagtttttcctaaagtacacaatgctctgatgccttccgggacctactgtgctagttctttgtggagagggacttgggaatatgtactctgaagaaactccgagttggtttggcagtgcactgccttctcactgctccaggatgggagggtctgtattagacaaatatgcctaaattctaaacatcagagtcagaagaaccttaacttttattccaatatatgaattatctctattcgtgctggatgggtggctgtataaactatagccttttcttaaacattttcaacaccaggaaaatcacaaagtagcttaccccacttttggacggctcactagagagctttttgggccttgaataaaattctgccttgctgggatggcccccattagatttagttctcctctctgcagatggacatatataatctctatatcttgtgaggaattctaggaagaacaagtcagccatcaggtattccctaagtactcttttaattaaccctttaatgattattagtatattatattgattctacttcagtttttgcttttttgttttgttctgttttgttttgagatggagtcttgctctgtcgtccaggctggagtgcaatggcacgatctctgcttactgcaacctccgcctgccgggttcaagcaattctcctgcctcagcctcccgagtagctgggactataggcatgcaccaccacatccagctaatttttgtatttttagtagagattgggtttcaccataatggccaggctggtctcgaactcctgacctcgtgatctgcccgccttggcctcccaaaatgctgggattacaggtgtgagccaccgcgcctagccctctacttcagtttttaaatttatgtcttctaaattttagcaatgttaaatcaagtttagcctaaagctgcctccttacatactttaagttcagcctccaggtttctctgtacatggtgaactataacctaaagggagttagactctagcctactcttgagccagttactgagttgtggtcaaaggtggccaactgttcaaactgtgttaaaataaggcagatgccaagctgtaaccaattcggctatttctgtacctcactttcgttttctgtatgtcactttcctttttcagtccataaatcttcctgcacgtggctgtgctggagtctctgggcctactctggctcagaaggctgccgaattcttgaatggttctttgctcaattaaactctgttaaatttaatttggctaaagttttcttttaatagcaagaaatgtgccatttataaagtattacttaaaccatggtataattttaaaagagattatacagaacttaacagtgtttaaacaattttaaagtgaagtttctagatggccatgaaaaaacattgaaagctttaggtctttgacaggaatttaagaagaggcaagccagaagagagggtgagataagacaaagggagctgaaggtacatcagaacacattttaagattttcagaactctactaagggtctgccactgtcttctgggattaaaaggaaaggatcaggccaggcgcagcagctcaggcctgtactcctagcaccttgggaggcttggcaggcagatcacttgagctcaggaggcagccagatcacttgagctcaggagtgcgagaccagcctgggcaacatggcaaaatgctgtctttacaagaaatacaaaaattagccaggtgtggtggtgcacacctgtagtctcagctacctggggggctgaggtgggagaatctcttgagcctgggaagttgagcctgcagggagccatgttcatgccactgcactccaggctgggtgacaaagtgagaccccatctcacaaaaaaaaaaaaaaaaaaaaaaaaaggaaggatcagattccagttatgcacaaattaatgaattcattagttcaacaaacatttcctgaatagccaataggctgaagacagtgtgttaggcattctgggaaatagagatggagagaagcagtctttgccctcagtaagttgtaatttagagggggagaatttgagaagttacaatctgatccattctgggtttgaaagagccttttatcagggcagcagcatgtaaaagggagttttcctgctaaaattaaagataataatattagataaatgataatttctccaattcctaattttcatctaaagtagtgaagagatggtaaccaatttctattctcatagctactaacatgctttagccttctgaggtatcatattgccacctgggaagagggaaagaaagaaagggaagaaggggatgtgagagcagtggtttgaaggaaagaaaaaaaccggtgggcaaaacttcctccaggaggcttgaatagcttcatttacatctttggatcacatattcattcacatttctatacaagatttaattttaggcatttatgtgtttattaaatttataaaatttctttttcttgaacagatccagtaccctgaaatgctttatctctctctttcagtttaaccatttggtaatgagataggctgcttgtggttggttataatttgtttatatttcacaatttaaattgcattaatgtaaatcttctctttttacattctacattttcttcttgttaaaactttccataatttctttctctgaaaattattatttacttatgaataagtggaattctctaaaatcagaatttgtttttaaacaagggctcaagaaatacaaattcctccaatgatccttcaactctgatgttcagcaacaaattattgtgaacaaagaatctatctgcttaagctacactataggatatgcttcttttgtcagctctagtttttttcatagattgagctcatttaacttgcttattatatttatattttgggcatattaattttgacttaaacatactaacaatatacatttaaaagatgttttatataacttagatttttatacctcttttttaaaaaaatatatttattttagatacagagggtacacatgcaggtttgttttaaggatatattgtgtgatactgaggttagggcttctgttgatctcatcacccacatagtgaacatagtacccaataggaagtttttcagccgtgccccctccctccctccctccctttggaatccctagtgtctgtcgttcctgtctttgtgtctgtgtgtactcaagatttagctcccacttataagtgagaacatgcaatatttggttttctgtttctgcattaatttgcttaggataatggcctcctgctgcatccatgctgatgcaaaggacatgatttcattcttttcacggctgtatagtatttcatggtgtatatatgccacattttcgttatccagtgcaccactgatgggtatctaggttgattccatgtctttgctgttataaatagtgctgtgataaacatatgagtgcatgtgtctttttggtacaatgattttcctttgggtatatccccagtaattggattactaggttgaatggtagttctatttttagttctttcagagatcttcaaactgctttccacagtggctgaactgatttacattctcactgatagtatataagcattcgcttttgtctgtagcctcaccaacatctctcattttttgactttttaatgatagccattctgactggtgtgagatggtatctcattgtggttttgatttgcatctcactgatgattagtgatgtggagcgtttttcatgtttgttggtcgcttgcatgtcttcttttgaaaagtgtctattgaagtcctctgcctgctttttagtgggattatttttttcttgttgatttctttaagttccttatagattttggatattagccctttgtcagatgcatagtttgggaatattttctcccattctgtaggttgtctgtttaatctgttgatggtttattttgcagtacagaaactctttagttgagttaggtcccactctattttgaattagtacaattttactctatagcatacatacacacaaacacatacatatacacacacactagttacctacacaccaatacatatactaataagctcagaaaagaaatgttagtctattaattacatatatatttatatgctataaatcaattttcataatttgttgatatgaattaaattttagttatatttatgtgaatttattataatcatgttatcaaatggtgtgttaaaattttacaaacatgtttgttagaattttaagcatcttgtctttcaacatcaaggaaaaggcctacgtaatatttttactgtggttagtcaacaaacttaacaggcattgtgaatacaaaggtgatgaagatacagactttctcccatgttatacagtatgatttagttttagtgggagagaggaaaataaaattatttaggtgacagttttgctgcctgtggtacccaaataggtttaaccttatttatttttgcaaaaacaattaatgggctctcaggatttccccaggaaaattaaaatagtaaccaaatcagagtatggggatagtcacctgatttatttatttatttgtttattgttttcctgcccaggccttttttttctcacctaatttaaaaacaaaattgttagtaatatgtagaaaaatcatgagtttcagggtaaaattcaactacttcaacctcacatcttcatctaagagtatagatttaaaaatttatttcatcacttttccaatccctaggatggtagtgtttttcacttcttttccttagcaactttccctcagacattcttttggttatgactgtagaaagcgagccaacctacaacttctggacgacagtatcgccatatacatagctgggaaccaactgatctttctgaatttgaaaaccaaggaacagatctacctgcgaagtagcagtggtgaaggaattggcgtcattggggtatgccttcaataaattagaaaaaaaccccaaaaaaccctatctttttgcttgttctgtggaccagccaacatggttgttagatgccaacaccatgcacagtattgtgggttcacatgagatgcacagctgtctttattccaaggcattttcaattcagttattacagacactcattcactgtcactacctctgtgcactattataatattattatgtctttttgcagataaggaaatgggcttatagaggttaggtgacttccccatagtcgtgcaagtttttcatatttagattagaagtggagatgagtgaggagattttaaagaatcttaatctgaagactgaagcaggcacatggccatgggaatggagaaggtgaggaaaatgtgagacacacacataggatgtagacatagattgactatggaaacaggatatgttgagatatatggagtgaaagatactatcatgtttgtttctttcttgatcatctatctatatatagtatgtatacatgataaaagtccatgtcctcggagagtttgttataagactaattaataagttcagcaataatttattatgtaatactgtgcatccaacactacacagaacatataatggggaatttaaatgaagaagaactcatgacctgtatgaattcagagtttaaaatccatctaaagagacaagacctatatttgtaaaaagaaaaaaaaactagacacacaagtacatgataatgtggcaataactgtgtgcagatagccatgggcccaatgtaagggtcgtggattttgtggagggaagtcagtcggagcctatgaggtttcaggagccctgaggtccacaccatctgcaggggaccaagaaacatctaattatcacatatttatctattactttatggcagtaatagttttaaaatttctattttaatattttgttataaaataatttggtttgaggacagtagtcagaggtgtagtgtggtcaagcatgctaatcctggccaagcacggtggctcatgcctataatcccagcactttgggaggctgaggcgggtggatcacgaggtcaggagatcaagaccagcctggccaacatggtgaaaccctgtctctactaaagatacaaaaaattagccaggcatggtggcacgcgcctgtaatcccggctactcaggagcctgaggcagagaaccacttgaacttgggaagtggaggttgcagtgaactgagatcatgccgttgcacttcagcctgggcgacagggcaagactctgtctcaaaaaaaaaacccaaaaaacaaaaaaaacaaaagctaatcctaactctcatccacctggatgttgagcagttttatgtccacaaggccttttcttcatgtgtgctggagctgttgaagcctgggtagtgacagaggccttgcctccactgtccgtgttacctcatcttttctgaaacagttatccagttatggttcagaaatactttagcaaggctatgagaaacctatgagaaaagtgtttgggcaccctacctggaaaaggtagggtgaacctctatgttgagtgtaaagtaaatgatttactaattccaggtcttcaccaaaaataaaactcctggcttggcgcggtggctcctgcctgtaatcatggcactttgggaggctgaggtgggtggatcacttgaggccaggagttcaagacaagcctggccaacatggtaaaaccccgtatctactaaaaatacaaaaattagcaggtgtggtggtgcacacctataatcccagctacttgggaggctgaggcacgagaattgcttgagcctgggaggcagaggttgcagacagcagagatcatgccactgcactccagcctgggtgacagagtgacagagtctcaataaataaattgtgtctcaataaataaataaataaataaataaataaattgtgtctcaataaataattaaataaataaaactcccaaactcaaccccacagcagtttccaatatgaggcagaaactttttaatttactgtagacaagacctagaagggtaaaggatttgcatgaatcttcatccagatttctttgaccatatgttctacaccatatttctttacaaatgggaatctagatagatatggtcttaatccatgtcccccacctccttgagatctactatttcttaggcccgtttgcttcttgactctgatacttggcttgaatcctatctcttacacttaacacattgtagactgtgtgactgcaggcaagttacttgaactctgtgcctcagtttactcatcaataagatggagataataatggtatccaagctcacaaggttggtataaaatttaaaggaaataatgttatcttgggtaccaggattagcaatctatatctgagaaccaggctctttgtcttatatgtaatcaggggatgtgaaataatatctgaaaacagaattttataagcataatatgtgttttaaatagcttatccttataacagcttatttttattttcattttttggctggccatttacccttcctacacatttggcttaccaatagacaaaaataacagaaatgaccatactattttatccaacttatatggctatctttgaaaatactgacacaaatagtttatccagggcatacttactgtattttcctctgtgtctggtttggaaatattatatctttcttacttctggtaagtttacattcgtttgtaactttttccacagtgaaattttaaaaattgtgatgtaacctggtctggaaacaagaatcccatacattccatgaatttttctatacaaaatttaggttgatttatatgtagggtagacagttcatctcagtgattctcaaagcaaggtctccaaactagctgcatcaacatcaccttgttagaaatgtaaatcaccttgttagaatgtaaatcacgcagttagaaattaccttattagacatgtaaatgcaaattcttgagtcccagcctgacagattaagtcagaaactctgggtgttagggcttgcaatctatattttaataagttctttagtggattctgatgcacattgaagatagagaaccattgttctagctcttccaatggcaatgaaagaaattgtagagttagaaatggctgtcttaaagtaaaatttaaaatgtgtattcttctagttttcagtttcaattgtatccatcattaaatatttatctgatgcccatttttgagttttctattagagtaaagcctaataaattatgaaataatggatgctaaatactgcattaatcagactatttatacaaaaatctttcttttaatattttggtgaaattttatcttttgtaggttcatccacataaaacttatttcacagtagctgaaaaagggagttttccagatattatcatctatgaatatccttctctgagaccatacagagtccttcgaggtgagtccagaagcatatttaaatatttcatgttcaaggataacaacattctgaagaaggtgtgacattatttcataagtcaaggttctccagagaaacagaactagtggaagacagaaaagagatttattcaaattcacacacaacaatactaaccttaaatgtaaatgggctaaatgccccaattaaaagacacagactggcaaattggataaggagtcaagacccattggtgtgctgtaattctggagacccatcttacctgcaaagacacacacaggctcaaaacaaaggaatggaggaaaatttaccaagtaaatggaaaggaaaaaaaaacaaaaaaacaccaagggttgcaatcttagtctctgacaaagcagattttaaactaacacaaatcaaaaaagacaagggcattacataatggtaacaggaacaattcaagaagagctaactattctgaatatgtatacatccaatacagagcaccccgattcataaaacaagttcttagagacctactaagagacttagactcccacacaatagtagtgggagaatttaacaccccactgtcaatattaaatcaatgagacagaaaattaacaaggatattcaggacttgaactcaactctggatcaagtggacctgatagacctctacagagctctcccctactccaaatctacagaatatacattcttctcagtgccacatgatacttatactaaaatcgaccacataattggaagtaaaacactcctcagcaaatgcataagagttgaaatcataacagtctctcagaccacagtgcaatcaaattagaactcaggattaagaaactcactaaaaaccacacaacttcatggaaattgaacaacctgctcctgaatgactcctgtgtaaataatgaaattaaggcagaaatcaagaagttctttgaaaccaatgagaacaaagagaggatataccagaatctctaggacacagctaaagcagtgttaagagggaattttatagcactaaatacccacatcaaaaagccagaaagatctcagattgacaccctaacatcacaattaaatgaactagagaggcaagagcaaatgaatccaaaaggtagcagaagataagaaataactaagatcagagaagaacagaaggagatagagacagaaaaaccctccaaaaaaatcaatgaatccaggagctgtttttttgaaaaaattaacaacataggtacaccactagctagactaataaggaagaaggaagagaagaatcaaatagatgcaataaaaagtaataaagggtaaatcaccactgaacccacagaaatacagactaccatcagagaataccatagatacctctatgcaaataaactagaaaatctagaagaaatggataaattcctggatgcatacaccctaccaaggctaaaccagaaagaagttgaatccctgaatagaccaataacatgctctgaaattgaggcagtaattaatagcctaccaaccaaaaaaaactccaggaccagatagattcacagcagaattctactagaaatacaaagaggagctggtaccattccttctgaaactattccagacatttgaaaaggagagactccttcctaactcattttacgaagccagcatcatcctgataccaaaaccggaaagagacataacaaaaaaaagaaaacctcaggccaatatccctgatgaacatcgatgcaaaaatcttcaataaaatactggcaaaccaaatccagcagcacatcgaaaaacgtatccaccatgatcacgccgccttcatccctggtatgcaaggctggttcaacatacacagatcaataaacgtaatccatcacataaacagaaccaaagacaaaaaccacatgattatctcaatagatgcagaaaaggccttcaacaaaatttaacatcccttcatttcaaaaactctcaataaactaggtattgatggaatatatcttaaaataataagtgctatttatgacaaacccacagccaatatcatattgaatgggcaaaagttggaagcattctctttgaaaactggtacaagacaaggatgccctctctcaccactcctattcaacatagtattggaagttctggacagggaaatcaggcaagagaaagaaatgaagcgtattcaaataggaagagaggaagtcaagttgtcactgtttgcagatgacatgactttatatttagaaaaccccatcatctcagcccaaaatctccttaagctgataagcaacttcagcaaagtctcaggatacaaaatcaatgtgcaaaaatcacaagcattcctatacatcaacaatagacaagcagagagccaaatcatgaatgaacttccattcacaatcactacaaagagaataaaatacctaggaatacaactaacaagggatgtgaaggacctcttcaaggagaactacaaaccactgctcaaggaagtaagagaggacacaaacaaacggaaaaacattcatgctcatggatagaaagaatcaatgttgtgaaaatggccatactgcccaaagtaatttatagattcaatgctattcccatcaaactaccattagcattcttcacagaattagaaaaagtgattttaagtttcacgtggaatcaaagaagaccccatacagtcaagacagtcctaagcaaaaagaacaaagctggaggcatcacactacctgacttcaaactatactacaaggctacagtaaacaaaacagcatggtactggtaccaaaacagacatatagaccaatggagcagaacagagacctcagaaataacaccacacatctgatctttggcaaacctgacaaaaacaagcaacggggaaaggatttcctattcagtaagtggtgctgggaaaagtggctagtcaaatgcaggaaactgagactggacctcttccttacaccttatacaaaaattaactcaagatggattaaagacttaaatgtaaaatccaaaaccataaaaaccctagaagaaaacctaggcaataccattcaggacataggcatgggcaaagacttcatgacaaaaaagccaaaagcaattgcaacaaaagccaaaattgacaaaagagagttaattaaactaaagagcttctgcacagcaaaataaactatcattagagtgaacaagcaacctacagagagggagaaaatttttgcaatctacccatctgacaaaggtctaatatccagaatttacaaggaacttaaacatgtttacaagaaaaaaaaattccatcaaaaagtgggcaaaggatatgaacagatacttctcaaaagaatacatctatgcagccaacaagcatatgaaaaaaagctcaacatcactgatcatcagagaaatgcaaatcaaaactacaatgagataccatctcatgccagtcagaatggcaattattaaaaagtcaggaaacagtagatgctggcgaggctctggagaaataggaatgcttttacacttttggtgggaatgtaaattaattcaaccattgttgaagacagtatggcgattcctcaaggatctacaaccagaaatgccatttgacccagcaataccattactggttatatacccaaaggaatataaatcattctgctgtaaagagacatgcacacgtatgtttattacaacactatttacaatagcaaagacgtggaaccaacccaagtgcccatcaatgatagactggatgaagaaaatgtggtacatatacatcatggaatactatgtagccataaaaaggaatgagatcatgtcctctgcagggacatggatgaagctggaagccatcatcctcagcaaactaacacaggaacagaaaaccaaatgctgtgtgttctgactcataaatgggagttgaagattgagaacacatggacacagagaggggaacaacacacaccagggcctgttggggggtgggggtgaggggaaggaacttagaggacaggtcaataggtgcagcagaccaccatggcacacatatacctatgtaacaaacttgcacgttctgcacatgtatctttttttttttagaagaaataaaagagatatatttaatggaattgtcatggaaaaggggtcccgatccagaccccaagagagggttcttagaccttgtgcaagaaataatttgaggtgaatccatagagtaaaatgaaaacaagtttattaagctgagacgatggggttttctaatatacaaccatgtcatctgcaaacagggacaatttgagttcctcttttcctaattgaattccttttatttctttctcttgcctgattgcccggccagaacttccaacactgtgttgaataggagtggtgagagagggcatccctgtcttgtgccagttttcaaagggaatgcttccagtttttgcccattcaatatgatattggctgtgggtttgtcatgaatagcttaagctgataagcaacttcagcaaagtctcaggatacaaaatcagtgtgcaaaaatcacaagcattcttatacaccaataacagacagagagccaaatcatgagtgaactcccattcacaattgcttcaaagagaataaaatacctaggaatccaacttacaagggatgtgaaggacctctccaaggagaactacaaaccactgctcaatgaattaaaagaggacacaaacaaatggaagaacattccatgctcatggataggaagaatcaatatcatgaacatggccatactgcccaaggtaatttatagattcaatgccatccccatcaagctaccaatgactttcttcatagaattggaaaaaactaccttaaagttcatatggaaccaaaaggccacattgccaagacaatcctaagccaaaagaacaaagctggaggtatcatgctacctaacttcaaactatactacaaggctacagtaaccaaaacagcatggtactggtactaaaacagatatatagaccaatggagcagaacagagccctcagaaataataccacacatctacaaccatctgatctttgacaaacctgacaaaaacaagaaatggggaaaggattccctatttaataaatggtgctgggaaaactggctagccatatgtagaaagctgaaactggatcccttccttacaccttatacaaaaattaattcaagatggattaaagacttaattgttagacctaaaaccataaaaaccctagaagagaacctaggcaacaccattcaggaaataggcatgggcaaggacttcatgtgtaaaacaccaaaagcaatggcaacaaaagccaaaattgacaaatgggatctaattaaactaaagagcttctgcacagcaaaagaaactaccatcagagtgaacaggcaacttacagaatgggagaaaatttttgcaatctactcatctgacaaagggctaatatccagaatctccaaagaactcaaacaaatttacaagaaaaaaacaaccccatcaaaaagtgggtgaaggatatgaacagacacttctcaaaagaagacatttatgtagccaacagacaaaatgaaaaaatgctcatcatcactggccatcagagaaatgcaaatcaaaaccacaatgagataccatctcacaccagttagaatggtgatcattaaaaagtcaggaaacaacagatgctggagaggatgtggagaaataggaatgcttttacactactggtgggagtgtaaattagttcaaccattgtggaagacagtgtggtgattcctcaaggatctacaactagaaataccatttgacccagccatcccattactgggtatatacccaaaggattataaatcatgctactataaagacacatgcacatgtatgttcattgtggcactattcacaatagcaaagacctggaaccaacccaaatgtccatcaatgatagacgggattaagaaaatgtggcacatataaccatggaatactatgcagccataaaaaaggatgagttcatgtcctttgcagggacatgggtgaagctggaaaccatcattctgagcaaactattgcaaggacaaaaaaccaaacactgcatgttctcactcataggtgggaattgaccaatgagaacacttggacacaggaaggggaacatcacacaccggggcctgtcgtggggtgggagagggggtagggatagcattaggagatatacctaatgtaaatgttgagttaatgggtgaagcacaccaacatgacacatgtatacatatgtaacaaacctgcacgttgtgcacatgtaccctagaacttaaagtataataaaaaaaaaagaaaacaagtttattaagaaagtaaaggaataaaagaatggctactccataggcagagcagtggcttgggctgcttggctgagaatactcatagttattcttgattatatgctaaacaaggagtcgattattcatgaggtttccggacaggaaacgggtgggcaattcctggaacttagggttcctccctttttaggccatataaggtaacttactgatgtggccatggtatttataaactgtcatggtgctggtgggagtatccttaacatattaatgcattataattagcatataatgagtagtgaggacgaccagaggtcgctttcatcaccatcttgattctggtgggttttggccagcatatttaccacatcctgttttatcagttgggtcttttgacctgtatcttgtgccaaccacctatctgatctggtgagttagaaagcccaacctcctgggaatgcagcccagtaggtctcagcctcattttacccagctcctattccagatggagtcactctggttttaatgtttctgacactgctatctaatatgcgtttgtgtttctccccaagtcataaaatggaatatgttctcaaagtgtttttctcatgcaatatgtgattaagacttctttaccctcccctttcatataacataattcattctaaagccaaagatggagaatgtttttggaattgttcctttagggtattcttggcattcttacatcaccatgggctgactccctctcttttttttacaatatgtttttgaaaatgaaataaatgtgtccttatttattaggcttccatttatccttccagatgggactgagaagggatatgcttatgtggactttaactacagcggtaacttgctggcctctgttggtagtaaccctgactacacactgactatctggaactggaaagaagaacaacccatactaaggacaaaagctttttctcaggaagtttttaaggttactttcaatcctgataaggaagagcagcttactacatcgggatcaggccacatcaagtaggttgggtaaccaatagaggtgccagtagatatcacaggagtatttttctaagaggatctaagagctggagactttttttttttttttttttttttgctgttttggttaacattagaattatttaaaaatatgttattttaaaagctaactagtaatgcaccttttctaattagatatgtgggattttatttctgcaaacagcatagataaaataagggctttttttttttttttttttgaaatggagtttcgcttttgttgcccaggctggagtgcaatggcatgatctcagctcactgcaacctccgcctcctgggttcaagcgattctcctgcctcagcctcctgagtagctgggactacaggcacccaccacaacgcttggctaattttgtatttttagtagagttgggtttctccgtgttggtcaggctggtctcgaactcctgacctcatgtgatccacccgcctcagcctcccaaagtgctgggattgcaggcgtaagccactgtgcccagccaaataaggatttttaaatatagcctgctgccttcttataggctccacctcctaaaagagtttatgtagtgtcttaataactaacattgggatggtatttccaaattcatactgagctttcacatccactactgaatttcttttttgtagcaactcagtcttcatctgtaaaacaagaattatcacactatcattcctgacaaggaacactcaatacgaaacagtggcagaacctactcttgatcttaggtcttgctccaaactccatgctcttttcattatatcataccctcgtctatttccgggatggaatgatcttgtctttctctctctttcttccactttgtctcatgcatttgcgtaacaatcttctaccaccccagagcttcccataacttgattatcagtgtctctaagagaaagacatttttatccatcctgacttcctcttgtctcaatttaaatctggtctttttgttattcatttattagaaatatagactaattgagcagatttttaattgtaatctttggggaattgtcaaataaccttctgctagctatatgtgaaaattttccaatttcttatattttctgattatttagtaaaatctgtattttctatgccccatatctttggggaaaaggcagacattgaacagttaatttcatgtgtgaagtgctatgaaggaacccagagtatatggaagcatatcatcaggggacctaccattcctttggagaggatgttggctatctaggcttttagctttgtatcattggcttgttgatactctccattatctattttatatctacttggataggtcttctttttctacatggtcttcatcatcctgtccatttgtttagactattaataagaaaatgttagtaataacatttattgattgctttgatatgataggcactgttctaagaatttttcaacaattctatgaggtagatgttactaattttctcattttatacctgagaaaatgaaggcacagggtgatctagaaaagtgctcaaagtcacacagctagtaaattagaattctttggaaaacttttatgtcttctaaaacaatactgtctaatagaactttctgacagactgggaatgttctatgctgtctaatacaatagctgccagccacatgtagttactgagcacttgaaattggctagtgtgactgaaacactaaaatgttgattttatttaatgttaattactttaaatctaaatttaaatagtcacacatagctggagggtactgcattaggtagcacagccctaaaatataagatgcatgaaagcaggaaattttatttttcgcctgttttgatcattgcagaattcacattgcctacaaccttgccgggcaggtagtagatacttaataaatcttaatcagataaatgaatgaatgaatgaaataatatatgcaactatgaaatatgtaaatgtttgggtcatattaaaataaaaatcaataaaatatctttgaggtacattcagtctctttcttgtttgtaggttctgggaaatggcttttacgttcaccggtctcaagctgcagggatcactaggtcgatttggcaaaacaatcactactgatatagaaggctacatggagctcccagatgggaaggtgagtacagctactattctacaatattaaaattgtgttttcaagtacatatatgaaagcacacatatatgaaaattctaacaagctctgccaataacagatattattgtaaatgtaatgaacatttaattttacttcttcaattatcaattgtaattaaaatatttccctgaaattgtcataatccatacttacctaccattttctattttctttttactaaatatggtacacacatataaagtatgtgagcattttcatatattaacataatgacatatttgttactttttttttttttttgagacagggtctcgctctgttgcccaggctggagtgcagtggcgcgatctccgctcactgcaagctctgcctcccgggttcacgccattctcctgcctcagcctcccgagtagctgggactacaggcgcctgccaccatgcctggctaattttttgtatttttagtagagacggggtttcaccgtgttagccaggatggtcttgatctcctgacctcgtgatccgcccacctcggcctcccaaatatttgttactttcagttatgtcacagagttgcagtatttatgttacttacttttccccattttgtcttgctatcgtgatccaagaagacttattgggtcaaaggttatatacaaccatgtggcatttatttttattgtcagattattactcagaaagagcaaaccactttatagaggcatctgcaacactgcaactgtaatctgttaatttattctttaatattgttagtttctttcctttctttctcttataaaatttataggcatattgcctgaaacaatagttaattaggattagttctctatcaatattttacatagcttcctattagaatgagttatacattattatttgtgataatctcagttgtaagtaaatgccagcacacaaatatttaaggaaccaagttgtctagtcatctacctgactgaatattctcaattcaaaagcatggtatataggaggaagtaaaaagccttggatgctggcgaaactatatgtctaaatccatgagatgatcttaaatcatcccagcttcaaattctcaatactgtaagaattaagctaagataaagatcaatagaatccttgttaaaaacctggtatgagatatattttttaaagggttggtagaatttgtatagatatagggaagaaataagccattttaaatgatagagcaactgaaggaaatgtttagcattagaaataaatatcaaatttttagagggcaaattggaattaaccatttatgttggcaaaaagtggagaatttcagtggagaagtatgacttggtcctagtgtacaaggagtttaataggtaggcagaactactctacatgggaagagtagacttgcaaatgaaagaagtaataaacaaatttggccataaaatgccaggttgattagaagggaaatctggagtcaaggaaatgagctagaacagaagctgttgctgtcatctaaaaagagatgatcaagggcctagacttctcagaacaaatggaaaagggaagctagatatgagtcacatttcataaaggaatgctttgtaggtttttgtcatcactgctggctttcatcactggacagaagaaaataagtctaaagactctaccataaatggctgaggcttaagaacagaatcagtaaagtcggtagggttgttaaaaaataggtagacccaagagataaaggactgaataaaatcatcagtttctctagataagggggaaatggaaatgtagacctctagagcatgcaggtaaaaattagaatagagtttcccaaagtgcatttttatggaacatcagtctgtacagaagctccataaaaataagactttttaagtcaaattcctttgtatctaaaaattcctcttggtgattcccagcaaatacttctctattaaaagttcccaggggtcctagagaaaataaagttgtttgactttgtttatcctagcaacagccttctgaggctgtgcagtcagaataggaggttttgagccaccttgcttggattagaatgctgactgggtagttttgggcaagttacttaactgttttgtgcttcaatgttctcctctgtaaaatggggataataatagtcagggctatcattggcccatatggttcctttgcgggggtcagaaaaagctgtttgttctaggagaatgaggtaaccaacatgcacaagtgtacatggtatccctgataaatgtacctagttcatatggttttttgcattaaataacttaacatatataaagtactgaaccagtgcttggtacagagtcagtactcaataaatattactttatttgtgacacttgttaaatatcttaacaactaatgtttggtggcatgcacttgggaaaatgccagattaaacaggctaatttgagaaaagttttagatgattatccttgtttgaaattggatactattatgctataatctacttaattcagtactggccttacaagttatctaacatctaaaatttgatagtattacatttaaaaagtagactctcatctaattccactcctgtcttttgtcctaagagatgtaccaagaagtctattgtatacatacatgaacaattaccaacaacatacagcctaatcaaaaagatgtaaaactgatcatattgctggaaggaaatacatcaaaatgttattggtagttgtgtctggggtagtaggtcttcatttctgtatttttttatttttccatttaaaaattttataatcaataaagataaccttaaaaaataattttcacctactatttgaggcataaatatgtacacttacctgttttaatgcacatttcttttttccacatacctgccaggtgctctcagggtcagaatggggcaacatgctgctttgggaaggtggtctgatcaaagtggagctctgtcgagggacaagcaagtcatgtcacaatggtcccattaaccagataatgctgtatgagggtgaagttatcactgttgggtcagatggatatgttagggtaagttttctcgatacttggatggtagcacccacgtttaagacttgtagctcacccaaagggttttatttctcataaaggttattttgtgaaggagatcagtagtcatttactcccaaggccaactcactttaaataatgcttctcttgtggtaaatatttgcattcttgtcaaaattaatttactgcattttaccactgaaactttttgagagggcctcttgttattctgattctgttgaaataatagcttcagaagatgaaaactcatgttagcacaagatgaacagtagacccacatatccttccaaaaggctccatatgaatgggccattttgtaggaacaaaggtgctgaacatttgttagttattttttactgaggttaccacttagaaatacacccagaggtgaactgatggagtttgcctatggatgctacattcttcttgctccttatgctagggacctcacttgctttctcttggggacactctcttgcccaaagcctgggctaagctggaacattgctccagcatctaagtccccttgattgctattgtcacacttcttccacccactctgtgtagcactttctgttaatgagtattgtgctgtggctggtcaacctgtagccttgtgatttgccttgtagtcctcttggtagatattttcagtggggcctttcataagaaagtggcagtgttctattgacattctttaagaaatgttatcaaaagtaagattcttttttttttcttttttaagagtctggtcactctgttgccaccgattgagcttactgtgtttaatattgtttaacccatatctcccacagtgggtcctcttaccactggctttttgagccccagtgtatgttttttacatttacaatattaaatttaatcttgttagatttcacacatttctctgagaatcttttgtgtcctttattttgtcatatgatatatttgctatctttccaagatatacgttaccccaaaatgtctaaataccaagtgggagaaaacctcaggagaaaagaagttaaatatttcacagaggatcccttcatggacaccagtatttcctaagcttgcttctcttttcagagtctgtccttgtcttttcagtccttcacacagtaaatctttacctcttaccccatagaaaaaacctagcccaactcccaggggttagtctgatcctagtttgatccttaaccctaaccctgaccctcagatatttccctcttcccccaaccaggctaatctatgggacagtcttcccagagttcctttctcaaagtctcagttattcagtctaggatcacatggcagggtatgttgccagaactgtccagaatgagctttggcccctcacaggggaggtcctgctgagcctccctgccaccgtgaggtaaaactgtgctccttcactcttcctatagtattctagactcctctcccaatgaacaacaatctacacttcactgtctcactgtcagatagtaacatttactgtctcacttactgagacatgtttggtggtatgcacttggggaaatgccagattttcccaatgagatagtaaagtgtgaaatattaatattcaggaagagaaacattttctaatggagactttatctacatctatattctttgcttctaatgagatagtgcttgagtcattaagcaagaaggtatatttcccccttccaggggcctgctggtatgtagaaaacagggttcattataatgtcttgctgaacaactgaaccatatactcctatggccactttatgtaaaaagagacctaatagaaaccttgaaataaaatttgttttggataaattagaattcttatgcaaggctgtactttctcactaatctttataaatataaaggaaactataatagcttatcatacctcagttcagagtaaaatttcaggggtcaggttttggctggtgttcttatcacacttgttcattgttacttttcatgaaagaaaaagaaatgacttttgaaaaaaaaatcagggtttttctggcttagaaaataaatgttcagaaactactgatcgattaaagtattttcttttcattttacaagatatgggattttgagacaatagacactgctgatgtaatagatgagactggattgttggagattgagcctattaatgaacttcaagtagacaagaatgtgaatctcttctctatgataaaaatgaatgaaactggaaataacttttggttggctcaggtgtgttgcattcttgtctcttggctctttaacattacatggaccaaaaattaaagtagtagtatgattgatttggctacaagtccatttgactgtaagtgttatgagattgcttattgtgtggctttagtctaaaatatagaagttgtttttattaaatttcaattatactttaaaatatatgtgagcttttgatattattgcttgtccttactttaataaaacatagaaagaacatttaaaaaatctgatgaaagtttaaaatgataaaacaaaatactatttaatttttttaggatgccaatggagccatatggaagcttgaccttagtttttcaaatattgtaagttgcctattattcttattttctcctaactttcatagtaaaaacttttgttatttgtctttaaagtattctttatctttctccatatttcatcatggtcctcataaaaaacttgcctaacatgtgctactcttgagaattctctctctcgttatgattttacataaaaaagaatctatctcataacacaatttaccagaaaagtggccgtgtcaatacctaacattatatagtactttatagtttttataaatatatagaattttcatgtattttatctcatgtgatcctcatcactaccctatttagtagacaagcagctgttaccatctcattttacagatgaagaaatggaaactggcatttgaggtgacttgcgcaaaatcacacagccattaaggacaaagcccaggactctatctggttctcctaattctgaaccagtgttctttctaactttttaggctttttcttatttctatccaaataaaatcacatgtgttatatttttatctttgcatttttttaaacttgatcttaattctttgttactctgtctttgagatctagtaagctgtctatctattctcagacccaggacccagaatgcctcttctccttccattctggagctattgaagccgtggctgtttctcctctcacttatctcatggccacaactgccttggactgtaagtaggaactcttaataaaaatatgtctggccttgttttgttttatttgcaataaaatttttatatgtgtttgacttaagagcatttggggattttcccaaaaggggagcctcttgaatgcaagcgagttgagctgtggagaggagaggccacaaaacacagcagccatggttattgtgagagattaaaagaaggacaaaatctgtaaattgctcatgaaaatgctgctcgttttgatattgtccacatttgtgttttttctattctttccgtctcctttcttccttcttaacttatggcaaatctatatggactatgcaaggtgaaattgacccagcagtcaatcatctgttttcttctttattattcatgtttatgaattacctgtttgaggttgtacctgaaattttttacaaaagaaagttattgactgatttagttaagaaatttcttgttataatattcaacatgtaaaaagtgagccaagacttaaaaaaattatgtatataattttttttcttttaaaactgtctttctataggctctgttcgaatctatgattttgctagcaaaactcctttggcccagatgaaattcaaacaaggaggtactgcccttgtttgggtaccccgaatggtaagtttgttgttataatgaactaccagaatctattggtaaatatggtatatcaatgctattttctggaaatatagatatttgctgactcaaaattttaaggaataataaaagttttaagttagtttattttagtcagaatgtaatagaaatctttaccatgattgttgttatgggtttggtcttgtttttagtgaaattttttgccacctgtagatttgtaacagtttcatgttgcaaagcaatttcccaacagaactttgtgtatctagcctcgatccatctgactctgatttcattcattctattaatatttacagagtgccgacaatgtgccaggccttgttttagattctgggaatatagcagtgaataaaaagacaaaaaatacttgcccctcatggaccttacgctttagtgggagggaggcagaggcagatagtagtcaaaataagtaagttaagtacatgttatgttagataattataagaactatagaaaaaaattaggctgagatagggagttgttccatttatcaattgctgtgtaataaactatctcaaaatgtagtggcataaaataatcattttattttgctcatgtagtctttgtgttgggattcgggtgacagcagagatggattgtctctgcttcagagtgtctgggaactcagctgggaagacatgaatggctgggcctggaataatccaaaggcttcttgatcacaaggctgtcacctgggttggatgacttgaaggctaggctaagctgggactgccaactggagtgtttatacctaacaccctctccatgtggcttaggtttcatcagaacatggaagcctcaggacagtcacacactttttacatggtagctcagggctccaagatctagtgttccaactgtaaaggcagaagctgatgaccttttatggcccattccccagaagtcaaaatatcacttctaccatacttgattgggtgaagcagtcacacagtcacaagccccatacagaatcaagaggagggaacttaaaccccatctgtccatgggaggcccatcaaagatttgcagccatatttttaaaatgccatggaagtatttggggaaatatttaatctttactattttgggttgaaattaaagagaaaatattccaggctaaaagtaaatttggatataattggaattagggggaatttcatgatgggatcaagatcagaaagagaacttagtccagggaagagagccatcttcatgatgaggctagagtaagtagaaatgacagagcatttagattggcagacctagctcactcactatcctaatctagttacactcttaactgaagtcttaaaactacaatccaggtaattgaattgtttattcagatgatcgtgtaatgttcacagcatgtttccttttttaggcttatattcgagtaatgatcatatggattttaagctacaattaaaatgtcccttctccatacccccttgcctttctggaaggctacacatcagtttttatgactcagctcaggtcagacatcatctctgcatagccctccatgaatctaccttcaagtagagttagggcctccttcctctgtgattttcttccccttagtgcttgtgtgtatatctcttacagcatttatcagagcatactaagattatgtgctttattgtcttcccactagactgtttttcatggtgacaaccatgccttattcttctttgcatctccagtgcctctatagttactggtacatttagacacgtagtaaatttttattggataaacaacattcaactgaagttgaatggtgtacagcttttttattccctaaattctcataactgatggtcactgagctctacaggatgcccaggctcttccaagacagtagatttggtacattccaacattggtaggtttacatgtctagctgagacttttcctctaagctgcagactatgatatctttattttaaaatctcaaggggacctcgaactccgtgtttccaaaactaagtccatgatcttctgcacatccccaatcatccctctctctaaatcaacaatagcaactacaaaccacacacacacctggctcccttccagtgttttctgtcacagttagtgccattatcagtcatccttgactcctccctctgcttcattccccatatccagtaataccaagtagggccattacacctcttcctaaaatatgttcatatccctcatcttcactacattacctcagaccaatagttcccctgaagtgtagaagccatcttaaaagatctttcaaaagttctcccagcatcctatccaaaccacctcatatctattttccatactgcagctaggatgtcattttaaaatgagcaaatctgaccatgtcactaccacttccccctggaacccaactaaaaacactttgatggctttccactgctctgggatgaaggcttttcttattgtgacatggaagccattttatgatctgctgcctggcctgcctctcttcctctccagcctcctggggaaacattgttctcttactctagtcagactataactttttcttgagttctgttatttcctgccacaggacttctgcacaagttaaattctctcttaggagtgcttgtgccaccttcctgtacctagctaattcctgaacatccttttgttatcagctccaccatctctttcttagggaagccataagtcgaggtcagccttctttgttatatgctctcagagaatacatttctttcttttagcacttatttcagttcacaatttcacactcatttatgtgattaatgtctgcacctttcactagaccaaaactctgtgaaaccaagcactgagttggtttatattcaccactgagttgctgatgataggtgcttagcatgtggtaggcagacactctgctgtttgttcattcagtgtttgaattaatgttgtttatccttcctgtggtcattggttataaggaactatgctggaatggatagaggttaccagaaagtgatataaagaattgccaatgggcagccaatattaaattacctgagtctaaataaaatatctgttatatagtacaactttctcaatttaactagtttcaggtcccttatctttaattttctccaaggtaaacttcactggagcacaaattattgtaggatttgaagatggagttgttcgaattcttgaactttatgatccaaaagggctcacgatttttgcgggacggaagaaaattttggatgctgatattcagttgaaacaggttttcaaaccccatactgcttgtgtcactgctttagcttatgaacgtgatggggaaattctagccacaggggtaagcagtacatttcctttcttttcttgttgaaattttatagttaaattgccttataagtcctcctacttcatcatgtcttatttactgaaattcattttctatcaatatattcacattttgctttctttgtagtcatattctttcagcgtagtctgtgaataaccctctttttaatcagaagagagctggagcatgtgaataacacttaaaaatattcttacaaattgaattctaatgcttattttaggtgaattgaaaatttcaactggggaccatgctagttgtattatttataatcagtattttattcagcatagttatgttcttatatagaattgccataaatgaagagaataactgtgtaaattctttatgcactaataggtgagcatatgcatggtataatttttttgtgtgaatttctgaaagtatggtgatcatattttcagaaccacatactgaaacacatggttttccaaatgctctaatggggaaaattgagcaagttttagaaataagaattctcctagaataatctgggatatatgaccattgtagatagagatagcgttatgttattacatgcttttttgtgatctataggctagatttcatagtaatatatatttcgtcggtgtgtctctttttccttagagtaaagatcaaactgttttcttctttgaagtggaaagggattataagccgattggttatattaatactcctggacctgtgtgtcagttaatgtggtctcccatgtctcatgtaagtcattattatttgtcttcctgtttgaatctcaattactacatagtgaaactatcttgtagatagaaaatagcaggtggaatttttagcccactcctggttcctgcagtgagggtcagggatgcggcaacagaaagctcaggtggctgctgctggggttggcccgtagagcatcactcaggagccttgctctctcctcactgcctcctttctcttccgtgggcttattagttgaccatgatcttctctcaaaaaccagggttatatcaggctttgctccaacgggacttttggccacaggcacagcatgtcgaaatgctttcacctggatcagtcagtctctctaacaatcagaagctgaattctaaggtctgaatgtacttttcctcatctttatctctttacttctcctctgccctcaatccacatctattttctcttctatccttttatttcttctttcttagcaattggtaattcggtattgattactaatctcttttaatgtctccagttttactaaatgtgagcatatgagaattcagtcatctaaatattgattgactgtctaaaccaagtgctgtgccaggtgccaagatgataatactgatgaattgcatagaagtgccatcaggattattggagtaacgttggtaatccactttaagcttttctaaataaaagggccataaaatatattagtattatctacaaaatgctttttgaagttagtcaacaaatactcattgtttctatcttttctaggcactgtagtggattaaataagcagtacaaagtagtctctcaaggagaaaaaactatacatttaaaaagttaaatataccttatcattgaataataaggtttcacaaaggaattggtgactaaaatatcaatggtgtagaccaagcttgtccatcccatagcctgtgggctgcatgcatgtgggctttgaatgaggcgcaacacaaattcataaactttcttaaaactttatgagatattttgcaatttttttttttagctcgtcagctgttgttagtgttagtgtattttatgtgtgggccaagacaattcttctttttgcagtgtggcccagggaagcaaaaagattggacacccctggtatagagaatgtgtgttgtgaatttagagcagggaactatcaagaaaggaagaagttaaaattaagttattattttgtattattgtaccttgattttgagaaattggtaggatatgaccaaatgaataagagatagctacagatggttcaggtgaggggagtgatagctgcaaaggaagctctgtgagaaagcatgaatgtttatatcacaacatataatattatgtgcatccttcattcacttccctagatacaaagttaaaaagatcaaccaacatttggcaggggttggggtggtgagtgggaggggagtaggtgtgacattaaagaagtagcttgaaggagacctttgtggtgatggtatagttttgtgtcttaattgtcatgatgcttacataaatctatacatatgaaaaaatgctgtagagctgtacacacattctatactaatgtcaatgtcctgggtggttgtgtatagttgcataacatgtaaccagtggtagaaactgagtgaagggtatgtgatacctctctgtactatcttttcaacttcctgtaaatctatacttatttcaaaataagtttaaaaaaattaaaagtaatttttagtttatttgtatggctataaaggaatacttgaggctgggcaatttggctcatggctttgcaggctatacgagaagcatggtgccagcatcttcttctggtgagggcctcacgggcttgtagtcatgtcagaaggtgaaaaggagttagcctgtatagagatcatgtggtgagagaggaagcaagagggagagtggggagatcaggcgcggtggctcacgcctgtaatcccagcactttgggaggccaaggcaagtagatcacttgagtgcagcagttgagacaagcttgggcaacatagtgaaaccctgtctctacaaaaaatacaaaaattagccaggtatggtggtgcatgcctctagtcccagctactcgggaggttgaggtgggaggatcgcttgaggctgcagtgtgccaagatcgtgccactgcgctccatccagcttgggtgtcaagagtgagaccctatcacaaacaaacaaacaaaagagggagtggggaggtgccaggctctttttaataaccagctctcctgggaatgaatagaacaagaacccacccccttccccacctagggaaatcatcaatctattcatgaggcatccacccgcaagacccaaacacctcccattaggccccatgtctaacattagagatcaaattccaacatgagatttggaggggacaaacatcctgtaacgtacaagaccaaaacactcagcataatttaaaagtcattttgggcagtgctgcttgctagcacttgtatttctaatgtcatttgcaaattactaaagtaaaaagtaaattactgtatgtaactgacctgctacagactttaattgtccaaattgcaataggtcttagcccttaccagctgaaatatcagatctcatatctgagcataacgtattaagcttctgcctgatggctttgagtggttctggtaagggtgcgtcccatgtacacacagagccattctgtctgccatggctactaccatgttcactttggcagcagtgtggagaagatacaagggagccaggtcaggggcaggtggatctattgggcagctgtgatgtgactagagcatgaaagactgtgcagacaagagatatttagaagagagaattgacagaacttggtgatcttttatttttgtgaagacaattttgaggtatctaaatggagttcattatagtttctctaagacatgttcttcctcccgtattattcttggacttcattttccctgtcactaaagccagaatcttgagagttattctggtctttattattattatttgtaatttttgtggatacatggtagatatatgtatttatggggtacatgagatattttgataaggcatataatgcataataatcatatgagggtaaatgggatatccgtcacctcaagcatttatcctttgtgttacaaacaatccactcatactcttttagttattttgacatgtgcaataagttattattgactataatctcccggttgtgctaataaatactatatcttattcattctatgtattttttcttactcatataccatccccaatttgcaccccaccccccgccacacccaccacccttctaagctgctgttgaccatcattctactcgccatctctatgagttcagttgttttaattgttagctcacaagtaagggagaccatgtgatgtttgtctttctgtacctggcttttttcacttaacttaataacctccagttccatccaggttgttgcaaatcataggatttcattcttttttatggctgaagagtacacattgtgtatatgtactacattttctttatccattcatctgttgatggatacttaggttgctttcaaatcttggctattgtgaatagtgatgcaataaacatgggagtacagatgtactgatttccttcaatatactgatttcctttcttttgggtatatacctagcagtgggattgctggatcatatgttagctccatttttagtttttttgaggaaccccaaactgttctccatagtggttgtactaatttacattcctaccaacagtataatttactccacattcttgccagcatttggcattgcctgtcttttggaaaaaagccattttaacaggaatgagatgatatatcatagtttttatttgcatttctctgatgattcgtgatgttgagcaccttttcatatacctgtttgccattctcatgccttcttttcagaaatgtctcttcagaacttttcccaattttaaaattggattagtagattttttcccccatagagttgtttgggctccttatatattctggttattaattccttgtcagatggataatttgcaaatattttctctcattctgtgagagaaatattcttcactttatttagagaatttaattcactttatgaagagaattaaaagaaattctcttcactttattgatgtcttcctttgctgcgcagaaggtttttaagttgatgtgattccatttgtccattttcgctttggttgcctgtgcttgtggggtgttattcaagaaatctttgcccagtctaatgtcctggagagtttccccaatgttttcttttaattgtttcatagttttgaggtcttaagtttaagtctttaatccattttgatttgatttttgtatatagcaagagataggggtcattttattcttctgcatatggatatccagtttttccaaaactgtttattaaagagactgctctttgtgcaatgtacgttcttggcatctttgtcaaaaatgagctcatcgtagatgtatggatttgtttttgcattctgtattctgttctattggtctgtgtttctgtttttatgtcagtaccatgctgttttggttcctgtatctctgtagtataacttgaagtcagctaatgtgatttctccagctttgttctttctgttcagcatagctttgtctattctgagtcttttgtgattctgtataaattttaggattttttttctatgtgtatgaagaatgtgattgctattttgataggcattgcattgaatttgtagattgctttagatactatggacattttaacaatattgattcttccaatatatgaatatggaatatctttcctttttttgttcctcttcaatttctttcatccatattttatagttgtcattgtagaaatctttcacttctttggttaagttaatctctatgtattttattttatttgtagctattataagtgtgattacttttttgatttctttttcagattgtttgctgttggtgtatagaaatgctattgatttttgtgtgttgattttgtatcctgcaactttaccaaatttgtttaccagttctaatagttttttggtggcgtctttagattttaccaaatataagatcatataatctgcaaacaaggataatttgacttctttctttctagtttggatgccctttatttctttcttatctgattactctatctagaacttccagtactatgttgaataacagcagtaacagtgggcatctttgttgtgtttcagatcttagaggaaaggctttctgtatttcttcattcagtatgatactagctataggtctgtcatatatgggttttattgtgttgaggtatattccttctctacccagtcttttgagaatttttgtcatgatgggatgttgaattttatcaagtgcattttcagcatcaattgaaatggtggtgtgatttttgtccttcattctgttgatatgatgtaccacattgattgatttgcatatgttgaaccatccttgcatccctgggataattcccacttggccatgatgaatgatctttttaatgtgttgttgaattcagtttgctagtattttgttgaggttttgcatcaatattcatctgtgatagtggcctatagttttctttttatgatgtgcctttgtctggctttggtattagggtagtactggccttgttgaatgagtttggaagtattcccttctcctcatttttcataatagtttgagcatgattggtattcttaaatgtttggtagaattcaacagtgaagccattgggtcccaggcttttctttgctaggataatttttttattatggctttgatctcattactcataattggtctgttcacgttttgaatttcttcatggttcagtcttggtaggttgtatgtgtctaggaattttactatttcttcaaggttttaaaatttacttgcataaagttgctcatagtagcctctactgatcctttgaatttctgtggtatcagttgtaatgtctcctttttcatctttgatttcatatattttaggcttctctctcttattttgttagtctggctaaaggtttgtcaatttatcttttgaaaaaaacaactttttaatttgttgatcttttgttttctttcaatttcatttaattttgttctgatctttttcatttattttcttctactaattttgagtttggtttgcacttgcttttttagttctttaagatatgccattagttatttgaggtttttctatcttttttgatgtagttgcttatagctataaacttttctcttagtactgctttcaccgtataccataggttttggtatgttgtgtttctactgtcatttgtttcaagacatttttaaattttcttcttaatttcttcattgacccactggtcattcaggaacatattgtttaattcctgtgagttcatgtagtttccaaaattcctttttattgatttctaattttattccattgtggtcagagaagatacttgatataatttcaatttttggaatgttttaagacttgttttgtggactaacatatggtctgttcttaagaattatccatatgctgaggagaataatgtgtattctgcagccattggataaaaagttctataaatatctattaggtcaatttggtctatagtgcagattaagtccaatgtttccttgttcattttctgcctggatgatctgtccagtgttgacagttgggtgttagaatctccagctattgttgtattggggttgatctctttctttagctctaataatatttggcttatatatctgagttctccagcattggatgcatatatatttacaattgttatatccttttactgaattgacctctttatcattatataatgaccttctatgtcttaaaatctatttttgtctgatgtaagtgtaattatttctactctattttgatttctgtttgcatggaacatctttctgttcctttactttcagtctatatgtgtctttatagatgaggtgtgtttcttgtaggcaacagatcactgagtcttgttttttaaatccattcagccatctcatttcttttgtttagagagtttagtccatttactttcaatgctattgttgataagtaaggacttacttttgccattttgttatttgttttctggttgatttgtggtcttctctttcttctctccttccttcttatctacgttttagtgacggtgattttctctggtggtatgttttaaatttcttgtatatccattgtatgtttttttcattgaagttactatcaggattgcaaataatatcttataacctgttattttaactgatgacaacttaacactgattttataaacaaactaataagcaagttcccacaactgggactgtgctgggtcagtcctgaagccagaatagcaccgagtcttgcccaaggcctgtggtaaccactccctggctactgcctatgtttgctcaagtccctaggtctctacagtcagcaggtggtgaagccagccaggcttgtattcccttcagggtggtgagatcgtcaggcaggtccagggatgctgtctgggagtcagggcctggagtcagaaaccttaggaatttgcctggtgttctattctactgtggctgaactggcactccaaccatgaaatgcagtccttcccattcttccctcccttttccacaagcagagaagtctcttcccaaggctgccactaccccagacctgtggcaagtactccctggctattgctgattctcactcaaggcccaagggctcttcagtcagcttgtggcgaatgctggcagtcctgagtctttcccttcaggacagtgggctttcctctggcccaggaccagaaatggtgtccaagagctaaggcttgaaattgggagccccaggtgcccacttagtgctctattccactgtgcccaagctggtacctaaactgcaagacaaaatacccttgactcttccctctccgtacttctcaagcagaaggagtccttcctcatagccaccacagttgggaatgtgctgggtcatacttaaaaccagcttgtcccagagtctcatccaaggcccacagtgtgtactacctggccatcactgttgattattcggggcccaagcgctctttagtcagcaggtgatgaatcctgccaggattgagtccttctcttcaaggggatgggttccctgctgtcccagggtgtgtctggagatatcatctgggacctagggcctggaataggggcctcacaactcttcctggtgccctacctactgtagcttagctggtatccaagttgcaagaccaagtcctctttatttttccccctcctctccttaagcagatgggagaattatctcccagagctgcgagctgtgctgcctggggttgggcaagaggtggcacagacactctcttggccacccaggctggtgtctcactatattgcatgccctccaaaatccactggctctgagcccagtacagcaccaggacttgtctaggaattgcagtccttatggcctagactgcctttcaagtttatttaggatcgcagagcactttaggctatggtggtgaggcttaccagaactcaggttctgactactgggctgaaccattcccctctgactcgggctggtctaaatactctgtctgtgggcactggctgagttgtgcccaaagctgctttctgttgtgacaggcagcactgtgttctgatgcagtctcacagttattgctctgtccttcccccaagtacccagattatctcttcatgccacacagccaccagagtggtgtcagcaattcaagactgtctttcctaccctctgcagtgcctctttcagtgatgtaaagttaaaaccaagtattgtcatcactcacctgatttttgattcttagcaaggtgtttttgtgtgtgtgtagatagttgttaaatttggtgttcctgtggggaggtcaattggtggaggcttctaatcagccatcttgctctgcctcctccctattctagccttgtccctgcctctaaccaccttgcccttcagtagttcaggaagacttattgattgtacaacctaggcatctcttcctctgtatcttctttgttcttcactgtttcatgtaatatgcttttgaacttgatcttctttgccttaaatgacaaacacaaaagaagacagcaatagacaaaagacagacaaaagacctacagactaataggaaataatgaacaagacaacaatagtaaatccttccctatcaataattattttaaatgtatatggattaaactccacaatctaaagacatagagaagctgaatgaataaaaaaaataagacccaacttggttgaaagtgaagagatgaaaaaagacattccatgcaaatggtaaccaaacatgagcagggattgctctatttatatgagacaacatagactttacataaaaaactatcataagatacaaagaataacatcttataataataaaagataagtccaccagaaagatataacaattatgaatatatatacatcccacctcagagcacctaaatatataaagcaaacattgagaaagatgaagggagaaatagacagtaatacaatgatagcagatttcagtatcccacttctaataatggataaaacatatagatcgaaaatcaataaagaaacagaggcagggcgcagtgcctcatgcctataatctcagcactctgggaggctgaggcaggcagatcacctgaggtcaggagtttgagacaagcctggtcaacatggtgaaaccctgtctctaccaaaaaaaaaaaaatacaaaaattagctttgtggtggcatgcctatagtcccagctactggggaggctgaggtgggagaatcgcttgaacccgggaggcagaggtttcagtgagctgaggtcacaccaccaccctccagcctgggtgagagtaagaccccagctcaaaacaaacaaacaaacaaacaaaaccccagaagacctgtataacaccataggccaaatagccctaacagatgtgttcagagcagtccaccgacagctgtagaatacacattcttctcaagtgatatggaactttctctgggatagatcaaatgttgtttttaccacatacaatgaagttttttaaaaaagaaagaaaatcataaaatataaactctctttctttgaggctcttgtcattcacctataacatcttttctttctacattgctatcatcttctgactacctggttgatcctgtttctttatttgaattttaagaatatggttgtctttctctctagtaaaagtgcaaacaagtattctgaatgaaattgtattagtctgttttcacactactgataaagacatacccaagactgggtaatttataaataaaaagaggtttaatggactcacagttcctcatggctggggaggcctcacaatcatggtggaagacaaaggaagagctaagggatgtcttacatggcggcaggcaagaagaagtcttgtgaaggggaactcctctttataaatctgtcagatcttgtgagacttattcactgtcatgaaaacagcacaggaaagacctgccccaatgatccgattaccttccaccaggtccctcccatgacatgtgggaattgtgggggctacaattcaagatgaaacttgggtggggacacagccaaaccatattagatattaaccatgtggataatcgatcaaacagcatcagactctgaacttcttgactccctcatcttccatgatttttatagtttgcccacacactttcacagctacccactggatacttattactgtgtttttgtttgctagacctaccataacaaaatacaacaaagtggatggcttaaacaacataatttctttccttacaattctggaggctagaagccccaaatcaaggtgttggtagatttagtttcttatgagaccactgcttggcttgcagacagctgtttcttgctgtgttctcacatggtcatctctatgtttgtgttgtctgtgtcttaatccccttttcttataaagacatcaatcatattggattaagggcccaccctaacaaccctgttttaacttatctcttttaaagatctatccccaaagatctatcagtcacattctgaagtattgagggttaggacttcaatatatgaatttttttctgaagggacacaattcagcacataacaactataagagctcaagcttaaaagtcaactatttggggccagttatggtggctcacacctgtaatcccagcactttgggaggtcaaggtgggtggatcacaaggtcaggggatcgagaccatcctggctaacacggtgaaactctgtctctactaaaaatacaaaaaaattacccaggcgtggtggcgggcacctgcagtcccacctacttgggaggctgaggcaggagaatggtgtaaacccatgagtcagagcttgcagtgagctgagatcatgccactgcactccagcctgggtgacagagcaagactccgtctcagaagaaaaaaaaaaaaaagtcaactatttggaaatcatcattctcagcaaactaacacaggaacagaaaaccaaacaccacatgttctcactcataagtggaagttgaacaatgagaacacatggacacagggaggggaacatcacacactggggcctggcagggggttgggggctaggggagggatagcattaggagaaatacctaatgtagatgatgggtcgatgggtgcagcaaaccaccatggcacgtgtatacctatgtaacaaacctgcacgttctgcacatgtatcctagaacttaaagtataattttttaaaaaaggtcagctattaaactagcctttactctgagttcaccctttgtctttttgagacaatttatttgccactgttatctccaagtagttctttcacgacacagagacctgtatttcatttaccatttgcttttcctaacttaatagttcactcttttcttcatttccttccatatccagcttaaaatttataattctttatttcaataatactatggactgaatgtttatgctcctcctgacactccaatttatatgttgaagcctaaattccccatgtgatagtatttggaggtggggcctttgagggaattaggtcatgagggtggagcccttgtgaatgggattagtttccttattaggggatgaagagaccagagtttcttctctctgtcctgtgagcatacaagaccaccatcgatgcagcaggaaaaatgcccttatcagatactggatctgccagtcccttgatcttggacttcccagctcctagaactctgagaaatgaatttctgtcatttaagctacttagtttatggtattctattatagaagcctgaactgactaagacaaacaaggatcaataacattcttccaatgccctgatttcctttatccctctgtcttttcttcatacccatctagcaaaagtccatctctgaatttccccaactactttatatttgcctatagtaatcagccaaaggctgctggagatagttatatgtcaatgaagattagctcctctataatttagtgattaaaatggcctggacataatccatgaaatcgttcagcaatcctatgacattgctcttatcaactccctctttcacacatggtgaccattttagaacttttcttctccacaaagcttcaagccttttgctcccaattcactctcagcatcacttacatcatagaaaaaccaggagccctcaggcaggaactttttcatttcccactaccaaatggaaaatcccatttacctctgtattcacctgctcctcgtccctcttttgcagtagagaagctgtctcccttcctacttaaggccaattctgcctcttgcccttttgtttctactttctcccagttttttttcaatattttacattatttctcttttctgtcatagaaatttaatcatacctgtttattggattgtttccttcagtatttaaatatgttcctgtttctcccacttacaaaatataacttccttgatcttatattctcctctagctactaccatatttctctaatcagccaactttctcagaaggattgactattctcagattccatttccttatctatcactctctcctttatgtgctcttacctgacttctagtctcatcattccaccaaatcagctcttctaaaagcaccaataatatccatttaacatttagttcttatctttcttgacctcttagcatcatttgatcctgtcaatctttccttactttttgaaataccatctcgctttcacttttgtgatactatgctttgctggttccctctcccacatcttgtcattctttctcagtctccttcactcagtcattgagtattaagtttccctaaggctctcccaatctctcctctcattctgttcttttgccctaggtgatgccatccaagccacaattttcttataaaagcaaatgttccacaggacttttgcacatggtgtttcccttgaggacttgctccctcaaaccctcccttaactcattatataattataatttatacattttttaccttgaagctcagataccactttctctgaaagctttatacaacctacttgttcttatgacacctctgcaggacttctgcaattacaatttacatttatttacctgatttgctaaatgacaagcttccattggaggtaagctacataatggcagatattatatgtttttcttattataaatttatccctaccacttaagaaaatgctgagtacatagtaggtacacaacaaataattgtagaatgaaataaccaaatgaataaacatttcaaataaagtatctgtaaatatcaagatggagatttcccattcatgattaaatgcatggttttgaagtcaagagacaggtctgggctggagagattaatttgaaatttaattgcatgtaagtggtaatgaaggttgtaagatttcccagaaaatgcttatggaggcagagaagagggaagaggacaaaaaccttgggaacatccacgtttgttaaactgagacagatagaggatgagccattaaagtaggatgggactgactacgccatccacacacgcagagtttccttggcagtcctaattttaatatctggtcctttcggctaacagatttcacaaccacatatattcatcagaaaatcagaaaacatatatgaatcacatatgttatagcatctataaaggaaccaaatgtaaatctaattttaataattattaatctttaatcacttaataatgatataacaataattagtactatgacaatataataattattaataaacttgactttttaccaataactgcagtgaggaattaagtgtgttttaaacatggctaatatacatagtaattatatttttatttataatctctttaaactatgcttttaaaaatttgcctaaatgtaaatatgttcaatttttcttttttagcctgaaagtactttactaattatctgtgaaaatggctatattcttgaagctccacttccaaccataaagcaagaagaggatgatcatgatgtagtctcctatgaaatcaaagacatgtgcataaaatgtttccatttttcaagtgtcaaatctaagattctggtatggaatattcctgaagcattatcttataataatttcctttccttagaatataaaatatcctatgttaagtgctgatggaatacacaaaagaataaaacataggccctgaacttaaggagtttataatctggtaggaaagcagctattagaaggcagtagtaaatagatactgaaatcaaaatgcaaagaaggaaattttaggggtctgcagaggaaaagagagaagatcctgatagagggatgggaggaggtcaaagatgactgcatggaagtgacatttagtacctaaagaatgggaggggccaggcacattggctcatgcctgtcatcccagcactttgggaggctgaggtgggaggatcgcttgagcccgggagtttatggctgcagtgagctgtgattgcaccaatgcactccagctcaggtgacagagtgagaccctgtctcaagaaaaaaaaaatagggggaattttgagaggtgaaaatagggcgatggcaataaaggctggaagaacatcccaagagaatgcagagttgtgagtgttttcaagaaatgaggaatagatcaataaaatatagggaggcaatttgttgaaggatgttgcaagagtctgtgaccaatgcatggagctccttaaatgccagccaagacatttcattttagaccactgggatccattgtgagtttgtgaggaggggattgatgtgatgatatcatataagtttgggagatatacctaatgctagatgacgagttagtgggtgcagtgcaccagcatgacacatgtatacatatgtaactaacctgcacattgtgcacatgtaccctaaaacttaaagtataataataataaataaaatttaaaaaaataagttaggaagattattctgaagggtgaacagaatgaagtagtaaaagatgggaggcggaaataccagtgtcagagggcttttgcaaaggacaattgatagatgatgaaggccaaactcacagtattactgaagttggaagcaactttccttgtggactatttcagtctacctaattcctgggttaacagtgataggctctaagagaagttatatttagcttctctattatgaaaaaaatgaccaaataatttctataaaaccaagattgatgggggtaaaacaaaaatgagtcattctaatgatttaaaagttttaatgataaaaatatattctcgcattggtgagtatttttaaatattatttgttacagagctgtgtatcttctttctattttcattgtcatccctaatggtgtaaatgaacgaatgagtcataattgtttttatacctacttaatgtttattttaaaagagattaatagaaattgaaaagagggagagacaaagggagttgaaggagaaaataagggaagaaaggaggaacaagctagcagcagagatgggagaagatggagaaaaagaatttcaggaggaggaagaggagaaagaggaggaggaggaggaagaagagccattacctgaaatatttattccgtcaaccccctctcccatcctctgtggattttactcagagccagggaagttctgggtttctttggtaagtaacaatgtaataatttttacctcaatcatatttcaatatagtttatagttattgtaacttcattctttcttactcttatgttaagatttcatttatctatttatttttttttagatttcatttattaaatactattgaagtcgtgagttttgatgaatgaatgtgggatatagttgtttttaaataatcttaacatctcttttatatgtcttcttgtgcagataattgtacagataaatctatagattatagattatctattatctgcttgtcaatcatacatgttccaggcaggtcaaagaggagaaggatcaagcgtagaaaggcaaaaggctaggggtttttccaaccaagactgttgttttttaattttgaaaagaatagctttcatggcagtactatccagtagacttttcttacttctcattatctacaactatgctgtggggtcatatgcaagtctaggaagataagtgtttttagatggtctaagtgccaccctgaacaaaatcagaacttggctcataaggaagaagggaaaaatggatattaggaagaaagtaccagggcctatcacaaggctgtaggagtatatcctccaattatacattttttactatttgcttgaaatattctattgatctactgcaaagcaagatttccttcattataattttgtcacaattttcagttccctccaccaaaaataatttcataaaagtgtgtgtggaagatcattactaattcatccctggtcctaggtctttagccaggccaggacactgactagccaaggactattgctgtaaggagtgatgagtgttgactttttccctcctcaacttttcctagaaatgtaacttttgtattactaaggaggcaagcagaaagaaggatggaaaatagcattggagacatcataggacatcctttattagttcctctaccctttctgcctgtcgtctgtgttttataaaacaattgtaaatggctactattgtatggagttcaaaggataaagggataaagaaaacatggttcctgccttcaggaagtcttcatttgagggaaagaggtacagaaacaattaatgtaatacaatgcaataaatttccagtgtcctggaaatatagatgcaaaaattactcattatttaacaaacataattgggaagattgggaagattgcttgagcccaagagttcgagaccagcctgtgtaatatagtgagatcccatctcaaacaacaacaacaaaacacaaacagaaaactccacgcatatttagtgcttactcttagggtttccaagtaaaattacatagtacatacttacactaaaaattatttttggctgggtgcagtggctcacacctgtaatctcagcactttgggaggccgaggcgggtggatcacgaggtcagaagatcaagaccattctcgccaacatggtgaaaccctgtgtctactaaaatacaaaacattagccgggcatggtagcaggtgcctgtagtcccagctactcgggaggccaaggcaggggaattgcttgaacccgggaggtgaaggttgcagtgagccgagattgtgccactacactccagcctggtgacagagcaagactctgtctcaaaaaatatatatatgtttttgtttgtctgaaatttaaatttaatagatgtcctttattttcatttgctgaatatgacaacttacttattctgtatcaggtatttttctaagtaatttacttaaccaactataaaataagtgctggttttttttgcattttatatatgaagaaaccaaggcatggaaatgttaggcattttatctgaggccatataactaatgagaagtgaaactagaatctggactcaagcaatctggctccagagttcatgccctcaaccattaagctacactggtgaacaaggttaaaacatagttaacagaggtagcaaagcttgagtcaacaatatgacaactctgtgcctgcagccaaacaaatggtgaagaaaaaccagtttcattttgaagtactgactgcagttctcaaatcaatactcacactgcaggccaattctactgcccagccatattcactttccaaattattacattaagtctttcttctcccctcaagcattttgtaccttctcttactcttcaatgataacctcatctcacatttcacagaaaaaaataaaagcagatggaatttccttttcttgtctcaattagatgtaacaccctatagggatctatattccttttgtctgctttgcctattgttataattggagaacagtctcctgcaactctccaaggacactgttcccaatggctccttgatcccatcccttctcattttctcaaaaactttgctcctgagataaaccacttggtctcctgtatcatcagtttctgtcttttctattcagttattatcatgagcatacaaacatgctctagtactaatcttaattttatttcctgaacctctctttccttttccccccttgctctgttacataaaaagttattgaaagaatcatctgtaatcattggcttaacttattcacctcctatttgatcttcaacccattccagttgggatatctccatcacttcactaatgatgataagctcagaggtcaattctctgtccatttgacttttcggaacatttaacagagttgacccctcatacttctcaaatgctttcttctcttggcttctaagacattacactcttctgaccattccatttcagcctcttttgctggcttctcatgtgcagaacaagctttgaagtttgaaatactccagagtgcggccttgggccccctctttcttgctaaggtaactacacagtctcatggctttaaatatcacttatcttccagtgaatctcaaatatttatttctagtcctgacctctcccctccacttagacttgtatatccaacttgacaatgctccttggcacctcaaaattaacctgtccaagacattacttttaaaccatacatgtcccatacaaacctgctccatctccatctcagtaaatgagacaatcatccacttagttactatgccaaaacctcgacgttattaaggattcttctctttcctttactatttgatacccttatatcgaaagtaggtctcttgtaaacagtatatggttaggcttaaaagaatcctataggattatatttgtcttttaaaaaagtactatgttcatttatatttaatgtaattactaatatattttagtttaaatctactatcttactaattatttctatttgtcgcactcattctaaatttattttctttcccttttttttaccttctattgagtgattaggtaattttttccacagttttcttcctctactagattattagttatacattcttttactattcttttagaggtgattttatttatttatttatttttatttttgagacagagtctcactcactctgttgcccaggctggagtgcaatggtgccgtctcagctcactacagcctctacttcccaggctcaagtgattctcctgccttagcttcccgagtagctgagattacaggtgtgtgccaacacgcgtggttaaaaggtgttagtttcttcatttttattttgtttgcagttcgtagcactctaaatttcaacatatctcttcagttttagaaaattctcagccattatctaccacagtgttgcttctggcctatcttttcactctcttgttctgggaccccaactttatgtgtattacatccttctcatgttccgtatgtatcttacatcattcaagaagattttccatcctttttgtctttctccatgctttagcctattttttctgatctctgttccagcttcgtaacttttattttaaagtttgtttttccaattgctttttattgaagtaaaagacatataacataaaattgaccatcttaaccatttttaagtgtacagctcagtagtagtaaacgtattcacaatgttgtgacgtcatcaccaacatctgttctaccgtcctcctcatcctgtaacactgaaactcccatactcatcaaatgataactcctgattcttcccttctctcagcccctggcaaccatactttctttcttatgattttgactactctaagtatctcaaataagtgaaattatatagtatctgtctctttatgactggcttgtttcacttgggataatttccccaagtttcatccgtgatgcagcatatgtcagaatttcctttcaaggccaaataatactccactttaagtatgtaccgtattttgcttatatactcagtcataaatagacatttggggccaggcacggtggctcacgcctgtaatcctagcactttaggaggtcaaggcgggtggatcacttgaggccaggagttccagaccagcctggccaacatggcaaaaccgcatctctactaaaaatagaaaaaattaggtggacggagtggctcaaacctgcaatcctagctacccgggaggccgaggcaggagaattgcttgaacttgggaggtggaagttgcagtgagccgagatggcaccactgcattccagcctgggtgacagagtaagaccccatctcaaaacaaacacacaaaaatagacacttggattgttcccaccttttggctattgtgaataatgctgctatgaatgaggtgggtgttcaaatatctctttgagaccctgcttgaaccctggaaatgattatttctttctccataagtctatgagactgcagatagctttgtccagcttcttagcctctcagctgccacatatatgtaacaaacctgcacgtgtgcacatgtaccctggaacttaaagtataataataaataaataaataaataaataaataaataaataaaagaaattgacagttgctccagggagtaaagcagtgccaaatgccaggctcacttttggctttccctcttttttggatcttgctattttggtagcttgccaatgccttcaaacacatttacaaaatttgttctggttgttctcagtgggagagtttggctgaaacaatctagtctgctgttgtcaaaagtgaaaacttagtaatttgattttcagaggtgatcatgatgttacattctctttcttatttattcttttattgttcataaagttgttctgacccttaatttgtttcctataataaggaatctcagtaataaggaaattagagttggagcaatatagctcttccagttgatcattcatcttctcactacatggataaatttttctgaaatagccctttctggaaaattaacagtgtttacagttaccttaaactgcaaactagctgtaaaaacgaggaactgcaaaaccctaatatttgttcctgcttattcagaataatgcttgaagaaataaaatgaaattctgtaggtagggagtcagaggtgatatctctcttgtattggcttttaaatgaaaacaaatcatcatgaggtttttattataattatatagttgtgtataaatggataaaggagatgctttatagaaataataaatctataatcatagaaattatgtagaagtagatgtttgaaaacatctattttatgttttcaaatttgaaataatcaaaaaattctcatgcatttatgtgtgttatattcaagtaccaccttctatgttacttatctcttttctagggtggctatgattctggttttctatatcactgtgagttccccccttgtgatgaaagcagtgatttcaaagaacaaaaagatgaacctattgatgtccgttatcttgcggatacagaggacaatcccatccaaactatcactttcaagtgagcagtatttcaaaaagctttaaaaaaaccatatcctgttagtgtctatgcttttgttcatcatggatattgtcaatttttaaagatccatccaaatgaaggggtactcaaaaaatatttggttaaataaatcaaatgaataaataaaatcaaagctaatactgaaattatatttaaatacccccaccaaatattctgtcagtatttttgtttatcgcacaattgaattgtatggatttacattctgctacctaggaggatgctacttacatagtcagaaatgaaggttcagggttacagttattctggagaaatcacaaatgaatcattagccctttaataattgagaactaggcaaatatgccagttattcttctgacgacccaatataatagcttcaaatttcaaattggccttttttctctattcttttgtattagtttgctagggctgccacaataaaacaccacagactaggtggcttatacagcagaattttttttctcacagttctggaggctagagttccaagatcaaggtgtcagcaggttggtttctcctgaggcctgtctccttaacttatagatatttgccttcttgcatgatcttttctctgggtgcatgtcatcccttatgcttctgtctgtatcctaatgtcctcttcttctttttttttattattatactttaagttctagggtacatgtgcacaacgtgcacatttgttacgtaggtatacatatgccatgttggcttgctgcacctatcaactcatcatttaaattaggtatttctcctaatgctatccctccctctgccccccactccccaacaggccctggtgtgtgatgttccctaccctgtgtccatgtgttctcattgttcaattcccacctatgagtgagaatatgtggtgcttggttttctgtccttgtgatagtttgctgagaatgatggtttccagcttcatccatgtccctgcaaaggacatgaactcatccttttttatggctgcatagtattccatggtgtatatgtgccacattttcttaatccagtctatcattgatggacatttgggttggttccaagtctttgctattgtgaatggtgctgcaataaacatacgtatgcatgtgtccttatagtagcatgatttataatcctttgggtatatacccagtaatgggatggctgggtcaaatggtatttctagttgtagatccttgaggaatcgccacactgtcttccacaatggttgaactaatttacattcccaccagcagtgtaaaagcattcctatttctccacatcctctccagcatctgttgtttcctgactttttaatgagtgccattctaactggtatgagatggtatctcactgtggttttgatttgtatttctctgatgatcagtggtgatgagcattttttcattgtgtctgttggctgcgtaaatgtcttctattgagaagtgtctgttcatatcctttgcccactttttgatgggattatttgtttttttcctgtaaatttgtttaagttctttgtagattctggatattagccctttgtcagatgggtagattgcaaaaattttctcccattctgtaggttgcctgttcactctgatgatagtttcttttgctgtgcagaagcactttagtttaattagatcccatttgtctatttttgcttttgccattgcttttggtgttttagacgtgaagtctttgcccatgcctatgtcctgaatggtattgcctaggttttcttctagagtttttatggctttaggtcttacatttaagtctttaatctatcttgagttactttttgtatatggtgtaaggaagggatccagtttcagctttctacatatggctagccagttttcccagaaccatttattaaatagggaatcctttccccatttcttgtttttgtcaggtttgtcaaagatcagatgtttgtagatgtgtggtggtatttctgaggcttctgttctgttccattggtctgtatatctgttttggtaccagtaccatgctgttttggttactatagccttgtagtatagtttgaagtcaggtaatgtgatgcctccagctttgttcttttgctcaggattgtcttggctatgcaggctcttttttggctccatatgaagtttaaagtagttttttccaattctgtgaagaaagtcattggtagcttgatggggatggcattgaatctatgaattaccttggacaatatggccatgttcatgatattgattcttcctatccatgaacatggaatgttcttccatttgtttgtgtcctcttttatttcattgagcagtggtttgtagttctccttgaagaggtccttcacatcccttgtaagttggattcctaggtattttattctcttagtaccaattgtgaatgggagttcactcatgatttggctttctctttgtctgttactgctgtataggaatgcttgtgatttttgtacattgattttgtatcctgagactttgccgaagttgtttatcagcttaaggagatttggggctgagacagtggggttttctaaatatacagtcatgtcatctgcaaacagggacaatttgacttcctcttttcctaattgaatatcctttatctctttctcttgcctgtttgccctggccaggacttccaacactatgttgaataggcatggtgagagagcacatccttgtcttgtgccagttttcaaaaggaaatgcttccactttgcccattctgtatgatattggctgtgagtttgtcataaatagctcttatcattttgaggtacattccttcaatacctagtttattgagagtttttagcatgaagggctgttgaattttgttgaaggccttttctgcgtctattgagataatcatgtgatttttgtcgttggttctgtttatgtgatggattacgtttattgatttgtgtatgttgaaccagccttgcatcccaggggtgaagcccactggattgtggtggataagctttttgatgtgctgctggatttggtttgccagtattttattgaagatttttgtgtctatgttcatcagggatattggtctaaaattctctttttttgttgtgtctctgccatgctttggtttcaggatgatgctgccctcataaaatgagttagggaggatttcctctttttctattgattggaatagtttcagaaggagtggtactggctcctctttgtacctctgatagaattcggctttgaatctgtctggttctggactttttttggttggtagggtattaattattgcctcaatttcagaacctgttattggtctattcagagattcaacttcttcctggtttagtcttgggagggtgtatgtgtccagaaatttatccacttattctagattttctagtttatttgcatagaggtgtttatagtattctctgatggtagtttgtatttctgtgggatcagtggtgatatcccctatatcattttttattgcatctatttgattcctctcttttcttctttattagtcttgccagtgctctctctatcaattctcttgattgtttcagaaaaccagctcctggattcattgattttttgaagggtttttttgtctctatctccttcagttctgctctgatcttagttatttcttgccttctgctagcttttgaatttgtttgctcttgcttctctagttcttttaattgcaatattagggtgttgattttaagtctttcctgctttctcttgcgggcatttagtgctataaatttccctctacacactgctttaaatgtgtcccagagattctggtacgttgtgtccttgttctcattggtttcaaagaacatctttatttctgccttcattttgttatttacccagtagtcattcaggagcaggttgttcagtttccacatagttgtgcagttttgagtgagtttattaacctgagttctagtttgattgcactgtggtctgagagactgttgtgatttctattcttttacatttgctgaggagtgttttacttccaattatgtggtcagttttagaataaatatgatgtggtcctgagaagaatgtatattctgttgatttgagatggagagttctatagatgtctattagatctgcttggtgcagagctgagttgaaatcctggatatcgttgttaaccttctgtctcgttgatctaataatgacagtggggtattaaagtctcccattattattgtttgggagtctaagtctctttgtaggtttctaaggatttgctttatgaatctgggtgctcctgtattgagtgcatatatatttaggatagttagctcttcttgttgaattgatccctttaccattatgtaatggcctttgtctcttttgatctttgttgggttaaagtctgttttatcagagactaggattgcaacctctgctttttttgctttccatttgcttggtagatcttcctccatccctttattttgagcctatgtgtatctctgtaagtgagatgggtctcctggatacagcacactgatgggtcatgactttttatccaatttgccagtttgtatcttttaattggagcatttagcccatttacatttaaggttaatattgttatgtgtgaatttgatcctgtcattaggatgttagctggttattttgcctgttaattgatgcagtttcttcctagccttgatgttctttacaatttggaatgtttttgcagtggctggtaccggttgttcctttccatgtttagtgcttccttcaggagctcttgtaaggcaggcctggtggtgacaaaatctctcagcatttgcttgtctgtaaagtattttatttctccttcactgatgaagcttagtttgactggatatgaaattctgtgttgaaaattcttttctttaagaatattgaatattggcccacactctcttctggcttgtagggtttctgccgagagatctgctgttagtctgacggtcttccctttgtgggtaacccgacctttctctctggctgctcttacaattttttccttcattgcaaccttggtgaatctgacaattatgtgtcttggggttgctcttttcaaggagaatctttgtggtgttctctgtatttcctgaacttgaatgttggcctgccttgctaggttggggaagttctcctggatgatatcctgaagagtgttttctaacttggttccattttccccatcactttcaggtacaccaatcaaatgtagatttggtcttttcacatagtcccatatttcttggagactttgttcatttctttttactcttttttctctaatcttgtcttcttgctttatttcattaatttgatcttcaatcactgatatcctttcttccacttgattgaatcagctattgaagcttgtgcatgcgtcacgaagttctcgtcctgtggttttcagctccaggaggtcatttaagatcttctctacactgttcattctagttagccattcatctaacctttttttcaaggtttttagcttctttgcaatgggttagaacatgctcctttagctcggagaagtttgttattaccaaccttctgaagcctacttctgtcaactaactcatcaaaatcattctccattcagctttgttccattgctggtgaggagctgtgatcctttggaggagaagaggtgctctggtttttggaattttcagcttttctgctctggtttctccccatctttgtggttttatctacctttggtctttgatgttggtgacctacagatggtgttttggtgtggatgtcctttttgttgatgttgatgctattcctttctgtttgttagttttccttctagcagtcagggccctcagctgcaggtctgttggagtttgctggaggtccactccaggccctgtttgcctgggtatcaccaatggaggctgcagaatggcaaatattgcagaacagcaaatattgctgcctgatccttcctctagaagcttcatcccagaagggcacccgcctgtatgaggtgtctgttggcccctactaggaggtgtctctcaggctacatgggggtcagggacccacttgaggaggcagtctgtccgttttcagagcttgaacgctgtgctgggagaaccactgctctcttcagagctgtcagacaagaacgtttaagtctgcagaagttgtctgctgccttttgttcagctatgccctgcccacagaggtggagtctatagaggcagtaggccttgctgagctgaggtgggctctgcccagttagagcttcccaaccgctttgtttacttagtcaagcctcagtaatggcagacacccctccacccgccgggctgcagcctcacaggttgatctcagactgctgtgctagcagtgagcaaagctccatgggcgtgggacccgctgagccaggcatgggagggaatctcctggtctgccagttgctaagacttttgaaaagcgcagtatttgggcagaagtgtaccatttttccaggtacagtctgtcacagtttcccttggctaggaaaggaaaatctcctgaccccttgcgcttcccaggtgaggcaacaccctgccttgcttcggcttgccctccatcggctgcacccactgtccaaccagtcccaatgagatgaatcagatacctcagttggaaatgcagaaatcacccatcttctgagtcgatcttgctgggagctgcagactggagctgttcctatttggccatcttggaagtgaccccctttgatatcttcttcttatgagtacaccaggcagactggattagaacctaccctaatgttctaattttaacttaattacctctttaaaagccctatcacaatgcagttacattctgaagtattaggggttagggcttcaatataggaattttaggggtgtacaattcagtccataacaactttgttattaatttagccacttgtcaattaagttgaaattaagcattattttcagattaatgggaagaacaatttacattttttgtttcgtagcattaacaaagttatgatgttttgtggaatgaaaaatggagcaattcgagtctatgtcctaaatcaaaatgatccttcattgaccagtttggtggactactggcacttcaatatgcatgacaataattatggatgtattaaaagtattgctaatagctttgatgatcgtttcttggtgactgctggagcagatggcaatatctttgttttcaacattttttctgaatttatgctaaggaaagacatgaaggccaaagttccatctcccagggtatgtaattaattaaccagttaattaataacaaactgtatttaaaaatagtgatattaaaattgttcatattcgttataaattaaaagttatttagacacattcaccttatggtctaatcttcctgctactattataatttgactttctggtgcttatatatcaaatattaaaggtattacattccccttattattaaagattggaattccccagattaaaaaagaatgtgtcagtttttctatgtagttaaaagtttgtatattaaaaaaactttcttaatcaaaggttttttttcaaagtttgcaattttttcagattttcttttgcttttcatttattcattcactcgttgtaagggctgatataggacatatgccataaagtgtggttttgataggggttgcaaaaatatagttgtttttagtattagaatgtgacaatgtgggtcatgattaaagattcagtataaagtatttttttaaaagcagaactagatttttggctttatgatgaagtttgagggttcagatccccaaattatgtccttttttcctgtcatagaacttgaatttcatattatcaagcaatttgtttggaaaaagtcagtaggtaataaccattagaattgctcctaaggagaaaggagttgtattagaaagattatagctaaaattcctttgaacatattggcttcccatttagcaggtagcctacttcaaagtacacataaagaatgtagggaagatatgagtaggtcaattttcatttcttctaatagcaaaatttggagtatgggctgctggttagagagggtccagctcagaaaaaggaattgcaggagggaaagtatatgaacaagaagaaaatgcctttctacctggtgccaaccctctctatagaaacccatattggatagaaaaatgtttattccacatttcaataatcatgtccttttatttacagctgcagtcaatatccctcctacagaaacccatattggatagaaaaatatttattccacatttaaatttatggctgcaatcaatatttctgaaatcactgaagcagacatagcttttaagaaagaaaaaatgagaaagattttttttaaaaaaaacaacagaaaacaactaagctcagcactggtctgaggttcttaccttactgtactttagaatcagctagggagccctagaagtacagatgccagagcccacccaagaacaattaaattagaatctctgaaggtgatgcccagtcttcagtattgtatacactatccttcatgtgattctactgtgtagctaggattgagacccattggcatatattttggaactgattggcatatttttggaacttttgtttaactcaaccttattggaaacaactgtgaccaggagacaattgccccagtatcagcatcaaatcctagaagttacactgatattagaaaaccaaggtacttagctctggccaataaaagaataaaaaataaataaaattcagtaaatttttgtcctaagtgattaatagtcagtacaatttattagccattactgtctcttatattgatcatgttttatgactttgcttttattaaagtcataaaccttgacttccataaaaatatgtagatttacatttcatacatataaagactaataaaacaactttatcaaaagagaatctttatttacttacaacaaatgacagcaaaacagagacctatcttctgtgaaagagaatagggaataaagtttagttttatttatgaacagactagttagcaaactaagactattttgttcactgggttataattctccttccttaatatcacagactaagacattttacagcacagtacctgaataaacagagtacttttaagtgatttactttttagttcccccaaatttaaactgatttcctttctgaagggagacttgtatttctgatttcatatctttctctttcaaggagggggattatattgttctttgcattttccactttatgtcttcctttgagaaggtgatataaaatgcttacttaaaatgtaaaaatatatatattgaaatatttctaggacacactgaggtatttggacaaatgattcatgtgataaaggtatatactgaaaaacagcattttgaaataaatgatctagacttttgtgaattctgtgttaatagcatatgaacattagtaatttacattttgaggggaaattatggggatattaacattttgcaaacatatgattaggttaagacttttcctatgtactccttcaaataaagcagaaacaagtaagtttagtaaactgcatttttttccttggatttttgtgaaactgattttcagacctataattattagaaattggcagaaaaagaaaaccgaaccaatttgagtttttaatttacttcttcctagatattttaaggaaaatgctatgcaattttaaagggctaaccttttacttcccttcctatagtttggaattgaaacagagccaattccagaagacattgaagatcccaaagcctacaggtatgggaatttttgataaatactgactaggcctgagattttgcaaaacaaatcaacagtgcagaagttgaccaagcttaatgaattttcaaattattgaatactaattttctctttctctgctgtttctgtatcacaacctgttattgttttaaatttctgttttcagtatcgagaatgctaggagaaaaagagaacatgacaagttaatgaaagaagtgggagaaataaaggcacggaagagagagcaaatcaaagctttgaggagtgaattttgtaatctattagaaatgaatgaaaaattaccaaagcatatgcagtttaaacgaacagtaagcctaatataaacttgatttttattttaacatatgctatttctggatagagatgactattttcccaacaagtagaaacacttaaaatcatctttcttttttgtttgtttctttcaaaatttcaatagccatttattttgggcatcttttaatttgtatgtggggtttatcccttttaatcagttaagattcttgttgacacaaattgttttacatcaactgttgttatagaacacatgaaaggaatacatggggaagaaataaagtagaacccaagagttcttttaagttttcttttatagagacatgaataacagatacactgaagtataaacaaaaattggcctgaagcgtccggtggctggcttcgttgggaactatggctaaacgtcatcccgatttgatcttttgctgcaagcagactggtattgctatcggaagactgtgtgaaaaatgtgatggcaagtgtgtgatttgtgattcctatgtgcatccctgcactctgatgcacatatgtgatgagcgttaactatggatcttaccagaggtgctgtgtgatctgtggaggccctggggtttctgatgcctattattgtaaggaagtgcaccatccaggagaaggatagggatggctgcccaaagattgtcagtttgggtaactctaagacagaccttttctatgaatgcaaaaaatacggcttcaagaagaggtgattggtggtggccccttcctcccctccacatcaagctgctgcagctgccagaaaagatgcctgctactaccagcagaaagggagtggagcccagagcatcacgaggagtgccttctagtgtactgtcaccttgccaccccctcctgtcccttcacccagacacatggaagggatggaaaaggattcttcacagagcactccggtacactgtatcagacaaaaattgatagattagctaatggtttttcttgaatttgagaagcaaagccctgttctccatattgatatgttctccctcaaccaagatcttctaaaaagaaataatattttagtcttctgcttgaggatttgactgtgaagctatgcctagtgaaaaacatattcttgcagcagctctggtggcagttatccttgaggaaccttcagtgtgtggtgggaagctatcagaacaagaaatgtaggcatttaatcttataacacttgtgctggtttcatgccttctgagaaattagaaaccctttctgttgctattatattaataaaattggtgtttgttttctggtaaaaaaaaattgtggtcagaatagcaggtcttcaaaatataaagcagaaaataaaatacaggtctttaggctgggcgcggtggctcatgcctgtaatcccagcactttgggaggccgaggcgggcggatcatgaggtcaggagttcgagagcatcctggctaacatggtgaaaccctgtctccactaaaaaatacaaaaaaaattagccaggtgtggtggtgggtgcctgtagtcccagctactcaggaggctgaggcaggagaatggcgtgaaacctgggaggtggagtgtgcagtgagccgagatcacgtcactgcactccagcctgggggacagagtgagactccatctcaaaaaaaaaaaaaacaaaacaggtctttattctacaatatgtataattatataatttcttataaattataaaattactttaacacaatacacaaaataatagtagtcattttttgatttcataagcatttcaaatacagacatgttgagttggcaaaattatactatagtacgcaacttttgcctcagtgaatctagcttactagctcaggctgaatattcaccctctgaagcacttcttcaggcatgccaaaagtaggactgacagatgaaattacatacgcggtttatctctctcaatccagtgaaggcttccagtgatctttaggaaagccaacacccaccatgaatagcatacacctgctaacttccctggccttccattaaatccacccaagggtaactcattcacaaaaccactaaccaagtaaatcataatttacttgatgcaactgacttggtaatagccaggaatcctgtgcaacaataaatgtgcccagcatggaattcagaacctggtctgcaaccaaatccaccatcaaaattcatacacagataaaacaaattcaactgccttttttttttttatattagtagcatcaagcttccccaagagagccagtttccaccacacaaaaagagaatcttgtatcaatttccccctactttataaaagtagatttttcccatcctatgaaacagttggtctctctgccctgcactgtgttcatcccttatctttcaggctggccccctctggtccagtaattctgtatgctgataaaactaccacagtgcacgctggaacttccagcagaccattagctccagttagagcagctgctcagtgggaccccaaaagtctccagcaagagaaacatcttctttccatagacttggaacatattccacaacttttttacatcgataacattaatactatcatacagagtaagaatctggacagcactaacagtgtataaaagatgaggatcatgtctgatattagcacttattctaccaaactcatgttggcaagacttaataaatgtcagaatttcttcactattcatgcagtgaagttgtcccatgagatccaatactgtcaaaccccaatagacaccactcattctcaaatactcagacatatagtattcataatcatctttctttgagccataggatgtgatacaatctacatgtttctacaataataaggtgtctggtgtatctcacttgataataacatggccatgtctaagagtgaagagccaaaatcatctttaagcttctttttatctggccagtcagtatgtttgcagcaaataaactactctagaacttgacacactgcttggtttggaagcagatgaacctctttacgtaatacaaagtttactattggatttacctaccacacttttttttttttttggtaacaagataagacataagtataggtttgaatctggttatcaactcttattgtacttagccaaaatacaatgggtagatgcatgtataatttgattgtctgtgcttctatttctataatttatcagatctgttgaaaagacagtacccggttgatctacaaaatttttaaaaatgatttaatttagttgtagctatgggggcaatcacaaaattgtttaagccaattttgtattctacctttttttcttttgtgacttattgcaaagccccatgtacctgctagtggttagctttttttcattttgtacctcttcctaaatggagttaattaaccatctgatcaagtaaaaacccataattcttaatatattcatgggttacccagtcctgtaattctagaagcactttgccaatttcatataaaaaatgctttggtgaaatcatgatttaatcatgttggttaaaaaaaccaggtcaaaatagttaaaagacctttatgctatttttctaagaaaaatgttgaaacttccagagcatgggtaataaaatttaagataaaaaacaactgaggcaagtgctgtgactaagcactttgtacacatcattacttaaatgacacacaaacacctctgaaaagaataattactactcacaatttatcacaaatattggctctgatatttttccagggatgagggtaagaaacatgagacctctaagtatccttatgggagaaagtggagccctttgtgaaggagattcaacaaaaacttggtgatgtcaagaagacaccagatactgctatctttcctgggtggggtcacaccaggggggatgttcagataatgatcagttgccataagcatctacctcatgtccaatttttatgtaatagtagtttctttgagatagcgtctttaaaactgtatactctccaaatattgatagcattcattatttttattgtgggaaaaaatcttaaactgtgtagctttatttgtattattgttaattgcgaagaacatttctccttatattgtggaagtaaagttaaaataagctgtttttcttttgtaatggacagagtttatgatatttggggaagagttatgatgcagcatgaaactggggacaaaactgaaatatatgaaacagagttgatacagtacccattttgatgaacagatcttcttatctgcaggattttgatgtagattcccaaatccgtgctgagatgcacagaaaaacagctttcaaaattcaacaagtggaaaaggaattagcttgggaaaaagagaaacatgaactcggcctaatgaagctaaagaatcggtaggatccatattctctacaagctaagatgtttgagagcacatgtgtgaataacatagtttatagtagtgtcagtgaagtggccagttaagagggctctggaagtacccactgacttgaaatctcaaggaatcctcttgtcactgctactgatattttcctgagctttctgtgcactcctttctagtttaagtgtgggaaatttgtttaacacttacattttaaaaattatataatacatatttactttgttttgatgaattatttattttatatcaaattaattaatgaacatgtatgtattaagaaataaaaaatcaaatggaaccaaaggactttaaacaaaagacaaccagaggtggctctggttttatccctctcatgcaccaatttgacttccaggggaatgtttttttttgccatttactgagatataatttacataaaatacgtaaatcttaacatcttgaaaattttttacagatgtataaatatatctactactcagattaagatagagaacatttatagcactccacaaagtttccccatgtccccctcacttcaggaaatactcttcaaagttgaatctttattgccatgtattagttttgtttgtgaattccatataaatagagtgttacagtatggattcttttgcatctggcctttttttaaaactcatatgatgtctaagattatcagtgttgttacatgtatcagtagttcattcttttccattgctttttaatctttctttaaaatgattataccacagtttatcccttctactgttaatagatatttgagttgtttctatttttggctaccataaataatgctactatgaacattgtgtacgttttttgatggatataagtgcttatttctgttggttatatactcagttgtggaactgctgggccataggttatatgcatgtttagttttgttagatcctgtcagtttttcaaaacggtttgaaaatttacactcttcagtttacacacttaccatcaatgtatgagaatcccaattgatccccactgtgttagtgtcttagggctactgtaaaaaagtactacaaactgattggcttaaaactggttatttactgtctcgcagttctggaggctagaagtccaaaatcaaagtgtcaggcaagttggttctttctgaggacttggtggggagaatctgttccatacctgtctccaagcttctagtggtttgccagcaacctttggttttcttggctgatgaatccatctctccaaatcctctgctttcactcagtgttctccctgtgtctcttcatataggtttccctgtgtatgtccatctctgtgtccaaattttccctttttataagaacaccagtcatgtttcattaaggcctgctgtcattatctcatttcaacttgattacctctatcaagaccctattttcaaataaggtcacactctgaggtgctgggggttagggcctcaacatagctttttggggggacacaaatccataatactcatgcttgggattgtcagccctttaaattccagctattctgtagtagcatctcagtatggtttaaattggcatctccctgatgagtgattttcagtcccttttcatatatgtaccaatcatttgtatattttctgttgttaggtgtttgttccagtcttttgtccatttttaaaactgggttgcaggaattatgtatatcttctggatatgagctttggttatttatatacatgagttatttttggttatttatatatatgagtgactacgtatatgacatgtatgtatgtgtatatgtgtgtgtatgtgtgtgtgtgtttacacatataaaataccttgctgtagtatgtggctttagtctcttaatagagttgtttgttgaatagaagttttttcttttactgaagttcaacttattagtctttttttaaagattaatgcttttgtgttatacttaaagaacttttgcctactcccaattcataaaataattctgttttcttctagaagctctattgtttttacatcttgaataatttttatgggtggtgtgagatcatgtcatttgtttttatattgatatccgattgacctagtattttttgttgaaaagaccatctgttccttactagattgtagtgatgcttttgtcataagtcaggtaactgtacatgtgtgggtctgtttctgaactctttattctatctcattggcctatctgtctatccaggtgccagtatcattctgtcttaattaaatcttgacatctaatattgtaaatcctccagctttgttcttcatctccaagattggttaggttctttgcatagaatcaacttgtcaatttttacaaaaagcctgctaaaatttgtattggaattacatggaatctatagaaataatagtcattaagaaataaattcctatttaggaataatagacatttaaataataattaaataataaatattatcttacataaacatgatatatcttaaaaagaagcagttttaatatttttacagtggttacaaccatatatctaaataatatatttatatgtatttattattagtcatttttattgacttcctagtgtggtagctaaggattttcctcactttaatgtacgctttcctctaccttcttgaaaatgtagaatatattataataattatatacattttatatataatatgtaattccacataattatatataaatgaagaatacattataataattgctttaatgtccttgtctgctagttatattatctgcatcatttctgtgcatgtttctattgactgatatatttctcttcattttggattacatttttatgctttttgcctatctgcctggtaaattttgattgtaaattttacattgtaggtgctagatatttctgtatatacttaaattttttttgtaactttttttttttaatactttaaattctagggtacaggtgcacaacctgcaggtttggtacataggtatacatgtgccatgttggtttgctgcacccatcaactcatcatttacattaggtatttctcctaatgtgagtgagaacatgtggtgtttggttttctgtccttgtgatagtttgctgagaatgatggtttccagcttcatccatgttcctgcaaaggacatgaactcatccttttttatggctgcatagtattccatggatggagtctcactctgtcgcccaggctggagtgtagtggcgtgatcacggctcactgcaacctctgcctcttgggttcaagcaattctctgcctcagcctcctgaatagctgggattgcaggcacctgccaccatgcccggcgaatttttttgtatttttagtagagacagggtttcaccatcttggccaggttgatattgaactcttgacctcgtgatccacccgcctaggcctcccaaagtgctgggattacaagcgtgagccaccacgcctggcttaaattttttttttcaatttcaataggtttttgggggaacaggtagtgtttggttacatgaaaagttctttagtggtgatttctgagattttggtgcacccatcacctgagcagtgtactctgtacccaatgtgtagtctttaatccttcaccatcccccaccctttcccctgggtcccagcagagctaccgggctccaggttggtactggggaatgtctgcaaagagtcttgtgatgtgatccgtcttcaggtcttgaagccatggataccagaacctgctccagtggaggtagcaggggagtgaagtggactctgtgagggtccttggttgtgtttttgtttagtgtgctcgttttgtgttggttggcctccagccaggaggtggtgctttcaagagcccatcagctgtggtcctgtagggaggatgcaaacttgccctagagacacctagttaagtattcaggtttctcaggcagtgggcagggccgtatagagctcccaagatattatgacctttgtcttcagctaccagggtaggtagagaaagaccaccaggtgggggcagggataggtgtgtctgagctcaccctctccttgggcgggacttgctgtggctgctgtgggggatggaggtgtggatcccagtccaatagagttatattcccagggggattatggctgcctctgctgagtcatacagggaagttggggaaagctggtagtcataggcctgaccttgctcccatgcaacccacagtcctaaaggctggtctcactcctaccataccctcccaacagcactaagtctatttccaggcagctgctgagcagggctgagaactgccccagaccaggagcctccccattgagaaagcaggcagattcagttttttggcatctcagggaacctgcatgggtgatccagttccttcaaagggtctgtggattctctcagctttcctgggtatgttcctgtgatagttcttggagcaaaagttcatgatgtgagtctccacatgatgctctgtccccatccgcaagctaatcctgcctcctatctgccatcttaatctctgtatacttttaactattcttgagctttgttctggaattcatttaagttacatggaaaaagattttttttttttttttgaggcttgcctttaatctttgttaggtgagatcagagcagcctttagtctagggctaatttttttccagctactaagacaacactcttctgagcagaatatcctatgtcccatgtattatcaggtttatgggaacacaagctatttcaactgtgtgagatctgtggattattctgtctgttcctttcaggtgtttcttttcccagcctcagatagactccttcttatgcagtgctgattagtgcttaactgcagagtggaagggagccctctgcagatcttcagagctctctctctctgactctggttctctctctctgactctggttctctctctccctctgtctctatcgtgcagctgtctcctctctggtacttcactctgaaagttatagcacttcttaccaggtattaaatccctgaatagttgaattcctagataatatttcagtatttgaatccctgaattataaccagattgctacctgctaaaagatgaaagtggtgaagaagttcctctcaggaagaactctcaacatagcagcctatgtttggctttaataagtattcacagtatatataagttttgtgtgtgtgtgtgtgtgtgtgtgtgtgtgtgtgtgtgtgtgtgtattcatacatatatatgaatcctaactcgcaaacttaggtatgtaagtacatggctgttctttattttatttaaactaacttaaatctgactttgactctgggcttctattctatcaagaagataggaaagtcagtcttagtacagctgaagctcattgtctcattttcccagaatgcctgattcttttagtcctttcattctgtggtttttgtgctctgctggagcaggcaacgttttgtgagaccaggagccacctgtgccatagatcaaacacacatacagacatcactcttaaggccttaccatctccccagatacttccagatgcagggatcaagtgcccacagctctgggacccacttgcccatcctcctttgagtcagggttcacctctgcctccctaccgtccttgttattaaatcctcttttccttaactcctgctttccgtccctgatctggggaccctccatccaccatagcatcatgttttcagggaacatatggaaggagataacaagaacctagctagctatctgactggaatgtggggagaggataaagttgtaccaaataacactgggtattaccaatgttttcatctttaccaatctaataggcaaaatataataactcttggttgaataatctgcatcctttttattattggtggggttcagcatttcctttcatatgcctgtggttcatttacatgtattcttctgagaattctctgtttagatttcttgttcatttttctttgggttctgtttatttcccacattatttttaattttagcctctttatctatattacagatatttgccttttattctacatattgtaaatggtttctcctgctctgccatttgccttaaactttgttcatatttttctaactgtgcagaatttttaatttttatgtgatcaaaaccagctatattttccttcatgttgtgtttggagttggttccttccagtgggttcttggtcttgctgacttcaagaatgaagccgcagacttttgcagcaagtgtttacagctcttaaaggtggtgcagacccaaagagtgagcagcagcaagatttattgtgaagagcgaaagaacaaagcttccacagcatggaaggggacctgagcaggttgctgctgctggctggggtggccagcttttattcccttatttgtccctgcccacatgctgctgattggtccattttacagagcgctgattggtccattttacagagtgctgattgtgcatttacaatcttttagctagacacagagcgctgattggtgcatttacaatcctctagctagacagaaaagttctccaagtccccacttgacccaggaagtccagctggcttcacctctcaatcccccctctaaacaggacaccccaactgctgttgggaattgggcaatgactgctccagctacttcctgctgggtaggggtgaagaaggggccctgtagttgtagtgtcctccagagggtaactctctaggtcagccgaagggccagtgggtcaatccaggagtccttggtagaagttggtagttgaactcattaggttctatttgtaagaccatctgtagcttgatggcatcgattctggaggaaacaaatttgacagggaggttaaaaacacagggcccgaaggtgagtaatagcaagatggctgtcacgggaccagaaaggggagaagccatgtcgcccaactccagaggttggtatgagagtttgaaaggcgttgtctgatttcagaagccttttcctgtaaatgccggttggcatctcgtactatccctgactggttagtgtaaaaacaacactcttcccctaagaaggttcagagtcctcctttctcagcagtgaggagatctaggtcttggcggttttggagagtcactgctgccaaagagtctatttgggattgtagagtaaggatagatttcattatttcttgcaaactgagaaatcctttgagagtgtgtggtagtaggataatgaagtagataaactggctattccagttcctgtagcagtagccattcctaaccctataattaggggtattagttgtatggctctgtgctgatggacttaagctttgaggggtactgatagggtctgatttcctcaagattagagttagaataatacatgttacactgttaacttttagcaaactttacttttgttgaaaaccttgtaagtttgggatttcagttattctttgctattaataagatctcgttcagtccatattaacttagaatttgtatagatggctccttcctgattctgtaagtactttaatgtttggctgagtgcagacagctcacacatttgagcggacccattattaggcaattttcctaaccctgcctctacaagagtttccttataacttactgaatacccattgagtctttttccctcaatcgcccaggaggaaccatctattgtcctgtcctgaagggagttcctcctaggtctggtcagacccctgtatggcaaccaatcaagacctagatcccctgttagtaaatctgctgggtcaaatcatctttttccaacagaaccagccccacacttcaagatttgagccagtaagctacccctttgcctttcctctttttttgacttaggatatttctgacctggtgaggtgtgctcacaatgaggttacctctaaaagttattttcccactttcttctgctagcaaagcagccaccgccacagattgaatgcacctgggccatctgtgggccactgggccaaggatctctgataggaaggctacgggttgtcagtggcctcagtgctttcgggctacacccttgtttacactgacaacaaggtggtattggagtgttataaggtcatggagaagactgtcaattatcaattataggttttaaatttaccctggcttttaaaggaatagggtacactcttttctttactacttccatctctctttctttctcttcggcttctttgtctctttctctctttctgactccctctttgtctgtctcttcctctctctctttgactttctgtctctctctctctctctgactctctctttgtctctctgtctctttctctctctctgactttctgtctctttctttcttcctctctgactccttctttgtctgtctcttcctctctttccttctctttctttttgacttcctgtctttctctttctctctgtctttgtctctctgtctcttcctctctctctctctctttcctctctgctggtctttctctgcctctgccagccgcttatgctgctgttctcccctctccttccccttttcatggcttcggcagtgtaagactgccacctcgttgggtttttgcactgtgtgcaataactccatggtttccttgtgatatttaatgggggtgcctccagaggttaggaactccctttctttccatattgcagaatgggcatgtaggattagataagcatacttactatctgtaacaaagtctcccaattacaactgaggaggtgggagaaatacctggctacaggctgtcccaggattcctcggatggtaacagaccttgaggatagctgtctgggacaggagattaacactgagaaagctgcaccagtgtccaggaggaagtcaatttcctggtcctcaatggttaaacatacctggggctcagtgagggtgatgacatgagctggcacttgccccgggagccctcagtactgttgttggatcatctgtttaggggcttctggcccagagaacctttgtcctctgcggcagtgcaccttccagtaattgcctcgggatagtggacatgggcaagggagcagcttgtttctcattggacaatcttttttaaagtgtccttgcaaaccacacagataacaagccctaccaggtgattggcctgctccattttctgtcctctctaaccaccgaggtttgtctgagggccatgactaagcctgcggcctttctctgatctcgcttttccttttcggcatgttcctcttggtacctattatagaacactgaggttgccaggtttaataatgcctccagattttgttcagggcccagggctagcttttggagctttctcctgatacctgtggctgactgggaataaacttatcttttaggataaattgaccctcgagggagtcggctgacaggggagtatattttcttaaggcctcccatagcagcttgaggaaggcagaaggattttcttcctttccctgagttatggtggacatcattgaataattcatgggctttttcttaattgtccttagtccttctagaacacaggtcaacagatatttgcaactccagtccccatgatctgagtcgaggtcccagtggtgatccatactggtgacggcttgctgactggtagggaatttgtccctttcttcggctgtcattctatcatttacttgactaagataccaggtatctccaactctcaggttgtagctaaagctgcattcttttcattaaaggccagggtttgatctaacaatagcatgacatctctccaagtgaggtcaaaggtttgtcctagaccctgtaggacatctgtgtacctatcgggatcatctgaaaacttccccaggtctgccttgatctgctttaaatcagagaggaagaaggggacatgtacccgggttgggccaaattcccctccccctacagcttgaaggggacataaccaatagcctgggagtttttgtggtcccttggagatttctttgcttatttccttctgggcaggggagattagaggaggcttatcattaataggaaggggggctatagggaggctaggatatggaggtaagctgagagatcctcctgtgggatgtaaattgcaagctttgcatagctgtgtattctccttcaatgaaaagaaagcttggagataaggtatttcactctatttgccttccctcttacagaaaaggtcaagctgcaggatagtattgtaatttatacttccctcaggtggccatttttccccatcagagagagaatattggggccaggctgtagtgcagaaaaaaatgagccacctctttttcagggtttgtgggtcaaattggtcccagttgcttaggatgcatttcaagggtgagcctgttgatgcctgagtgtttcccatgtgaaaggaaaaaccgcccgcggttttgatttgtttacttccccccgacccaagaacctgcaatggtccctggaccctgctgatcagaatagttgcactcaccaatgcagcagcagaaacccctcttgcccaagaacctgcaatggtccctggaccctgctgattggaatagttgtgctcaccaatgcagcagcaaaaacactagttttcctcttagaccacaaggaggacagaggaaggttggatttagtggcccttaccaatgcattcttgaaaacctgcactcttgcctgtcctcttagaccacaatgaggaccgagaaaaatcggatttagtggcccttactgatgcatactcaaaaacctgttagagtcctaggcattctcctgttagtatcgggactttacccctgtcctataaagatgttatgcccccaaaatgaagtagaggaccataccctgagggagggaagggatctctggggttggaagagtgacgccttttgtcctcacttgaataggaaggatatcatttctgaagctccccacatcctagcttcaggaatagcttttgttaggcccgcttgtctgaggaaggatcctaaaaggatagttggtctccccacccaatggggctttgggcaaaaattatatctttctgattggtgagcccaggtgcctaaagaagggaacagagtcctgaagtttatactagaaatcattataggagaaactagaaaagcaccagagacggggtagtttttagaagcgggattagcctcagagaagagaggcaggaggaagtttgtctgacaggcattaagacccaggaggcaagtgtcaggatagataggatagacaggtgagccttgcttgggcgacgtgactttgagagttccactcatggctacagggtcaaccaactttttgtcagaaccccagaactgaatgattttcctctctcttgaccgttggctcagcccaaaagcggaagctgtttccaggcaaaccaacgctcccaactccagagtcgggggttgttagagagccctttcccagaaagcctgacacccatgtctttagtccggcggccacgctagtcacttttaactggctgacaggtgtccagtatttagcccccgaattctaaggaaaaatagggcagaagagcaagctaaaggggtctgatggtactcactgcatggcgatgtcccatctgggtcgccaagatgtgtccagagttggttccttccagtgggttcttggtctcgctgacttcaagaatgaagccacgggccttcgcggtgagtgttatagctcataaaggtggtgtggacccaaagagtgagcagcagcaagatttattgtgaagagcaaaaaaacaaagcttccacagcatggaaggggacccgagtggtttgccgctgctggctggggtggccagcttttattcccttatttgtccctgcccatttcctgctgattggtccattttacagagtgctgattggtccattttacagagtgcggattggtgcctttacaatcctttagctagacacagagtgctgattggtgcacttacaatcctttagctagacacagagcgctgattggtgtgtttttacagagtgttgattggtgcatttacaatcctgtagctagacccagagtgctgattggtgcgtttttacagagtgctgattggtgcacttaaaatcctttagctagatacagagcactgattggtgcatttttacagagtgctgattggtgtgcttacaatcctttagctagacacagagtgctgattggtgcttttttacagagtgctgattggggcacttacaatcctttagctaggcacggagcgctgattggtgcgtttttacagagtgctgattggtgcacttacagtcctttagctagacacagagcgctgattggtgcatttttacagagtgctgattagtgcatttacaatcctttagctagacacagagtgctgattggtgtgtttttacaaagtgctgattggtgaacttacaatcctttagctagacacagagcgctgattggtgcgtttttacagagtgttgattggtgcatttacaatcctttagctagacacggagcactgattggtgtgtttacaatcctctagctagacagaaaagttctccaagtccccactcaacccaggaagtccagctgggttcacttctcaatgttaatctgggtctcatggaaaggctaaaatttaaaagttccagtgggcaaatacataaaggaaataagtcttaaagagatgagaaagatagtatgtatgaaagaaaagggaaaattaaaaagaaatagtaaatcattttaaaagcagacatagagtttaaaagattaagttagaaaaatagtaagaaaggcaaacaagctaggaataatcaatctatacaaaaataaattaaattctaagaagtgcttgtttgtgtgtgtgtgataattatgaaccaatgcccccaaataacaaggcaattgatgaaaaaaatttgttaattaatttttttagttgatagatgaagagcttttaaaaataagactctgtgggctatgagagaaagatgaactagagattagtatgatttcctgagcttaatgttttttacagaggcaaataggggaatctgatagattgggactttcattaaatgtcattaaacatggaaaattgaggggcaaagagtagaaatgaagaggtttgcacttttattcaactgctcaaggtctgctctttttatagttactatgtgcaaataaattgcattgccacatgtatggaaacacacacatatatatacaccacacataccatgtaatttaagaaaacaaaatgtatttttaaaacattttgtgaggtgaagaatgaacattttttagtctctggggaatgagagttaaaaattatttttccactttttgatttagagaccttcactcacacacagatattaacatatttgtttatataatttacatgtttatatttatttgtatatctatgcatcaaaacacatacacaaactatatatctattataatatctattatacattttatataataatctattatatatgtatatgtatagatatatatacataatatataatatatagtctattatatataatatgtagggagatggattctatttcctcagaatttgatatgatctatttaccattaaactgcagtttacctgcaaaattttcatttttccacatattatgaaaacactggtattatagtgattaataatgagttgtttagtattttcattagaaagactatatttgctctttaatcaagtccaatccaactttcatgacatcctggttggtatatatatgttaaaatttgagtctagcacaatataatgatataataagaatagtgtattgtagttttattttattacttagtaattatgcagaatgatcaaaatggtgactactgcaaatacttgttttattttttcagatttcgagatccactggaaagtgatactattgtggttcatgccatactgagtgaccacaagatatcctcttacaggctggtgcagccctctaagtactccaaattcaaacgagctagtcaatcagagagaaaaccaagcaaattggacaggtttgaaaaagagggacctggaagaaaggacagccagagagatgcaggtagcctatgacaagaaggcttttaaattcttatttactaagacttcaaaagtgaattgtctgtggacagaaccattgaaccttctttggtggcttgagctcaatctcttgcccctcttccttccatgatggttttctttggagtaaataatcaagagagacaaaagtgtatggtatagctgagaatgagaggccacattttcccaagaaatgctccatgtccactttcctctttaatgtagtttgtaagaaaacctaccctggtcatgtgactgagagtgggtgagaggactggatgctgctgttttcttacttgccacatctagctattcttaaatctaggatttccccagatgctaggttctaggcagtggttcgttttagattcctgggccctattccaaagtgtagggctaaaacactgcatttcagactattttccaagaacatatgctttaaatagaatgatcagagaatagaggtatgaaaatagtacctctaatccctgcaacctgtttcttctggctgcccacaaggtgactgcagattagtaaaagaacaagaattctggaaatggcttggagagccattcaataataaataaaaggtgctgctgcagcctggctagatctaggctattgacagtgatataatacgaacattaatattggtttatcttcttcattgggaactctttaatgtctcctttttgcttctaggataaattctgaaaccgctgtcctgatacttaatccttccacaatctatccctgttctacgtttccagtagtgctttctcatactgttcagcttgtctgtttagtcttttgtcctgcctgctgctccctgattatgtctaacacttcctcacccaggctcctgccagagtgacctcttcacttctctcctgtctgaattctaccaattcttggggatgtagcttaaattacacttttgtttataaggccttcccatgaccacacaggccacataaactcttctttctctataccgctatatatttgaaatttgaaatatgaaatatgatgaaatggttatttataactatataaatatctcatattatttaatttttcatgtctctaaagcttgaacacgaatagagtaattccccaataggaacttgttagtagaccaggtgtggtggctcacacttgtaatcccagcactttgggaggccaaggcaggtgaatcacttgaggtcaggagtccgaggccagcctggccaacatggtgaaaccccatctctactaaaaaatacaataattagctaagcacggtggcacattcctgtagtcccagctacccaggaggctgtggcgggagaatcacttgaaccccagaggtggaggttgcagtgagccaacattgcatcattgcactctagcctaggtgacaaagtgagactctgtctcaaaaaaaaaaaaaaaaaaaagaaagaaagaaagaaaagaaacttgttagttgatacagccatttttttttaattttttatttatttatttatttttgatacagagtctctctctgttccccacgttggagtgaagtggtccaatctaggctcactgcaacctccacctctcaggttcaagcaattctggtacttcagcctcctgagtaactgggattacacccggctaatttttttttttttatgtatttttagcagagacgggggtttcaccatgcccaggctggtcttgaactcctgagctcaggcaatctgcctaccttggccttacaaagtgataagattatgggagtgagccaccaagcctggccataaagccaataatttttaaattatttatttgattgtgtttctgatgagttttttagttggcttcagagcacttcagttggtatgtgcaacctcaaattgtatgtatcgaattggacttactcgatttttctccttttccccaccatcatctcacaaacactctttcccaacatgttagtggtccaccatcatttatcatgttctctaattgtttattatatatcttatcttgccaactttttaataagggttttaaaagcaaaaaatgtggcttagatctttttattttgacattccacagtacttattatggggttgaattcatagtagttggtcaataaatacatttttgtttttgttttgttttgttttgtttgagacagagtctcactctgttccccaggctggagtgcagtggcaagatttcagcttactgcaacctctgcctcctggtttcaagcaattctcctgcctcagcctcccaagtagctgagattacaggaatgcaccaccacggctggctaatttttgtatttttagtagagatggggtttcaccacgttgcccaggctggtctcaaactcttgacctcaagtgatccacccgcttcagcctcccaaagtgctgggattacaggcaagagccaccacaactagtgctcaataaatactttgatttacaaattcaatatattctctgtgttttttctaatgcagcaggttaaaaacaatatctgagagttttgtttttatgtctcaaaaaggctgaaaaatgttgattctctatgtaggtgggagtgttaccatacaagaagaatcaataatagaaaaagggaagaaatttcggcctaaaaccctaagtgaaatcatcgtggaaaatcaaattgagaaaacgagaaaacttatattaaaagctgaaagggcacaactaaagattcaacagcgaaaaaaagaatgggaggaactgtgagtttttttttacctaaactcttatctttttaatatgtgagccccaaaataatatatcttaaaaatctttatatttattgacattgttatcatttaaaatcaaaagtgaaaacaataaaaacaaagaaggagatattataaacaggtcagctggatcttttagggtggtgatactttggtagaacttctgtaattcttagagtttccggtccaggaattccattttgctaataatactgtatagtcagaatgatttttaagaattaagaaatgcttttctatctcaaaattataaacatattctcctgtatgttcttctaacatcttatagttttggctcgtacctttatctttaaccatctgaagttaattgctttcttttaaaaaaaaaaatccagtattgatatgggagtgctgggaagggaaaggagtggtccctttaaatgatatggaagggaggaagggaagtgctgggtagcgaaaggcgtggtcccgggctggggctccatccccacggacctaggtgaggacaggcatttcctgcccaagtgttgcatttcccaagaccaccctggcttgccatgcccctatcctgggcctattaaaacctgagaccatagcaggcagacacagaagtggctggacatcatgagggacacattggcagaagaagacacaagtaactggtcatcaagagcacgctgacaggcatcaacagatgccagcacgccggcaggccattgaccagtgggacgaggcagagtttggcgggacagtcgggctggggctgccgagtggcccaactccagggaaaaaccatctcccttctggttctcccattggtggagagctacttccactctataaaaatttgtactcattctccaagcccacatgtgatccgattcttccagtacaccaaggcaagaaaccccgggatacagaaatccctctgtccttgtgataaggaagggggtctaattgagctggttaacacaggctgcctatagacagcaagctaagagagcatcctgtaagacacgcccattggggcttcagctgcaaacattcacccctagacactgccatggggtcggagccccacagcctgcccgcctgtatgctcccctagaggtttgagcaatggggtactgaagaagcgagccacacccccatcgcacaccctgcgagggggacaagggaacctttcccatttaaactggggattgcggaaggtgagtgtgagtgaatgccaaacttttgggtctgcctctctttcgaaaccctgccacctttctctttcctgtgggtaagaggctctgtttctcttcactgagttttaaaaactccaccctaactgggaggtcgaaacccccagactttgtctcttttctgtctttgaaatggttcttatctctttttttataatgttctgagttttgttacaggctgtggaaatgttactaagctaaatgagcattaggctcagcctccgaaggtgaaaatcagaccaactgttcctagagatgccatgtatgcctccactttgacagctgcaggcatgcatggctcagggcacctctccttaccctttttcctcccagattgggcacctgggcatgcccgcagcaggcaagggtcgagcccaacagtcacgagcagggcgggagaaagccatgatggtagccgcaaccccacagggccaatggacatgtgcttctcgcccaccacgccaattgaccctctcctcccctggccaaggaattcaatctagtctgaactgggggacagatacaaggattagaaaggctcagttgcactaagcaaggggttcttcccccagactctctcctctttttgccccctaaactgtttttctttttttccttttctaagtgagagggctccccctagctctgtttctgatatgaaagttaacaggaatggcccctgctggctgagaactgcaaatttggcagggcacatttgagacactctaaatagatacaaacagcctctaaaatactttttcagtcccaacctcgattccaagcttcaggttgaggccctagaaagaaaatcccggtctgagggatccaaagccaggcaacaggcacaatgtaaagcaggaccaattcctgcggagtaaacctctcaccccatggaaggagaccatgcttcatggcataaacaggcccaaggtactcagttttccgacagcagggagaaatggaggcataggtgagggtggttaattcctattctccaggtttcccctacttcattggtacataccgcagtggtacctatggccagctcagggataaggggtggaaagtgaaaggaggatgctagctttctgtctccatcacactctgagttttcactgaaagaaggaaaggaatgagggctgcctctattccctgtctttcagaatgggcaaccagttctcttcaccacccccagctggagtgtatcctgaaccactgggactgtttgaccctcagaatctggaggaaaaacctctcatagccctctgcacaagggtttggccaaattatgatttacaggaaggatggcttggcctcaggaaggaaccattcatttttgataccattcagcagttggaatttttctgtggatgtgaggacagatggtctgaagccccatatgtgcaggctttgtatagcttgcaaggcaatccagacttttgccaacagtgtaggattgattgattcagccctcctgttggccatctcaggttgcaaggggtaaacccagggaattaaagatatgagtctcagaggcacccccagcagaggagtcagctctctccagccttgctcctccggatccaccttgacctccttatccagcttcagcccctcacttgccccctcttagaaatcctcaccctaaacaagccccagtctcactcttgcccctccaacagatgcccagtgaatttgggcccagtaaggccaaggtccccttctccctacaggacttacagcaaatgaagagaaatcttggcaacttttcagatgaccctgtgagactttccagaatttcacccaaatgtttgaacgttcctggagagatgttatgttacttttcaatcagaccctgacagacactgagaagcagtctgctctgcaagcagcagagagatttggggattaaaaaaaaaatctggtatgaggtagtttcacgtgacaagcacatattttcattggtttatttgccatctatatatttttagtgacatgactcttcgtgtctttttctcacatttgaataggattgttcgctcttttactgttgagattttagacttctttatatattctagatactagtcctggatatatactatatgctagttggatatatagtttacaaatattttctgttagtctgtagcttgtcttttcattcccttaacagagtttgttctttttttttttttttttttttttttttttgagacattgtctcgtgtgttgtccaggctggcatgcagtggtgcaatctcagctcactgcaaactccgcctcctgggttcaaatgatcctcccacctcagcctcccaagtagctgggattacaaacatgtgccaccacttttgcattttttttttagtagagacagggtttcatcatgttggccaggctggtttggaacccctgacctcaagtgatctacctgccctggcctcccaaagtgctgggaatacaggtgtgaaccactgcacttggcctcccttattagagagttttgtcacagagcaacagtttttaatttagttgatgtccaacttaccaattttccttatataaatcttgattttggtgtcaagtctaagaactctgccttgccctaggtcctaaatattttatcctatttttgtttaaacattttatagtttttcattttatatttaagctaatttttaaataagttatcagacttaggttgagatttgtttgtttttttcttacggatgtccaattactctagcatttttgttgaaaagacatttcctcctttgaattccttttgcacctttgtcagaaatcatttggacatatttgtgtgggtctatttctgggtttactttcaagtctgttgatctacatatctatcctcttaccaacactacattgtcttgattcatatatttatataatagatcttgaaatccagtagagtgattcctctcattttatttttcaaaattattttagacattataattactttgtctttccatataaatttcagaaaaatcttgtctatatgtatacaaaatcttgccataatttcaataagaattatgttaaagcagtgtattactttggggagaatttgtatctttattgtgttgagtcttctaatccatggacatggtatgactttccatttatttagatttttgatttctttcatcagtgttttgctgttttcagcataaaaagttctatacatgttttgttagatttgcacatatgcatttcttttttgagcaattttaaatggtattgtgtttttaatattggtgtctatgtgttcacattcactgctagcatagaaatataattgatttttgtttgtttatctagtatcctgtgacctttctgaactgtctcagttgtaagatttttttggtaggtttcttggtattttaagtgtagacaaccatgtcatttgtaaacaggaacagttttatttctaatctgtttgcatcttatttccttttcttattgcactggctagaacttccagtactatattgaaatacagtgggaagaactagcatccacactttgttccttatcttaggaagcattcagtggttaaataatataactgcttccatcctttacctcaatctacctatacttttatatttgaagttagtgtctttactaacttcactaggcaacataaaattgggtcatgtttttaaatccatgctgcccatttctgtcattcaatggtatatttagaccatttatgtttaatgtacttatttatatttagggcttacatctgctattctatattttgttttctgtttgttctattttttggatttctgttttctttcttctgctttactaaggaatttgtcaatgaattcatctgtaagtattctttgagggatagttttaaatacaaatttaaaatttttgttgttatagtgctatccagatgttctatttcttcttgagttagtttttataatttgtgtctttgaagaaatttgtgcatttcatctaagttgtcaattttattggcataaggtagtttatattactcccttatatttattttaatttctgtagtatctgttttgatgccctctgttttatttatattgttaattttcatattctctctttttcttgatcattccagctagtgatttacccatgttatagatcttttcaaagaactagcttttggtcatagattttaaaatattgtttggtctgctttctctgtcattgatttactattatttttataatttcttcccttctagttaacttaggtttaattagcttttagtttcttgcttcttaatgtgtaaacttgtgtataagctttgattctatgcccttcttcttttgtaatataaacatttaaactataaatttcctcctaagcattgagttagctgcattacacattttcatatggtagacatttattatcacttagtccaaagtatttctaatatcccttgtgatttcttccttgacttgtagtttagtttccaaagatttggggtttaaaaaatatcttcctattaaatttctaatttagttgtttgtggtaatagaaaatagtctgtataatttaagttattaaagatttatggagaactgtgttatggccacgcatatacagtctatctacgtaaaaattcaatatgtgcttgaaaagagtatgctttcttgcattgcttggcatagtgttctataaatgtcaattaggacaagaggattgataatgtttttcatatcttctatgcctttctctctttgaagcatgattttttatgattattcttgaatgtcctctgtactcaacaaggtctctccagttgatgggaacatgagtgattcccagctatgtgtaaactatgagaattatttgttctacagtttcccagtaattgtacttttcctaggaattgttctttgcccagcttcatggtggttcacattacacatgtacagattaatactcagccaaaatgttaaggcgctatgtagatttccagaagcatttctttgtgtacctctgatattcttttccacaaattcttagcaccaaatttggcctccctgtactctgatctctgtctcttcagtcagtgagttcactgggctgtatttgggatcctgatcctactccacaggctggtaatttcctctctgcggcagccaggagataataaggatcatgtctttttacttttctcaagaattacagttttatgctgcttattttcagtgtctgaacatagttgtttcacatattttttgttcagttttctggttgtttatattatgaggataataatgggccctgttactctcacatggccagaggcagaagtagctcttctcttcccttccctccctttttctttccttcctttttctttctttcctttcctttctccctttctcctttccttttctttaaaaatagtaatccttcattttagtgcagttttacacaaataaatgattatcagttaatacaatagatggtatgggtttcctgtgagagctatgtgtacacgctcatgttggctagtagactttactttaaaaaattagacaggaatgttgtgatctcccaatgaagggccttttattagtaccaaggtactatgatagcccatacctttagatacctgagtgcttccaaagcaagagttcagtttctgtagagagtaattcttcaattttagtctggatataaagattgccactgtttcgtatgtgtgtaggtgggaaagtttgggagggcccaactggtttaagcatttttttttcaatcctttaattaattttgctaaatatatctagcattccattccactctctatacctgtcctctttgtgcttggagcattctagggacttcaccaagaagataatattcaatcctttttgtggccttatcttgtgggtattctgggctatagtttggtctggtttattcattaatgtaatttcatcttctttttgtcttccagaaatggatcagtgtcactggtttgctcatggctttctattccattcttagcttttctgataatttacaatgttttgtacttctatattgtcattttcagggaatctggggacagagggagaggcaaatatgtatgctcatgctatcatcttaaactagataccttttctgaaaattttacagcaagcacttatgcaattacaaagtttaattttctgggcatgatggctcacacctataatcccagcacattgggaggctgaggtgggcggatcatgaagtcaggagatggagaccatcctggccaacatgatgaaaccccgtctctactaaaaatacaaaaattagctgggtgtggtggcgcatgcctgtagtcccagctgcttgggaggctgaggcaggagaatcgcttgaacctgggaggtggaggttgtagtgagccaagatcacacaattcactccagccaggcaacacagtgagactccgtctcaaaaaaaaaaaaaaaagtttaattgactttttagtcattaaaaaacccacctaatttccaaggcttaatttatatcaagagaataaataacaatgttaatatgaattacttagaagtgaaccaaagcctaccagtaattcagattatttcagtacaatctagtgattggttcctgtttatataattgtatattattttgcttgggatactttaaaaatagtaattgacttttaaaaaatgcttgggctctgtgacaaaagtggcatcacagatttgaaatcatacttttgtttcatgattaaatttgaatatatgcctatattaaagtagacaaattagagtttattgtcatatttgtgtgtgggggggttgtctgtttttctaatagatacaagagtaaacctggtgatgactatgaagatcccaaagatcttcaagccatcaaagaagcccaggtgtatatgggagatttcaatctgaagacagccccagactacaagatacctgagcacatgagaataaatgctgccaagaaggaagaggaactaggacacctagattctttggtacttatctacagattttatgacaatggagaaggcaccctgggttcttaattaaattctgctaaaaccactcatttccctatctggtcaataagaatatataaccatagaaatttagaactggaaaagacttccatgattatctagaatgtcctctttttacaaataaggaaactgaggcccagagaggacacgagatttgtccatggttagtcagctaatatggaagaaccagctgcaaatacttacagtatatctgggggttatagatgggtattgcctgacaggtatggcagggtcatcaaggatatctggtaatctaggtcggagtttgactctctgatgaatgtctctatctctttttttgctgtggccttattagaagtattaatacatctttgttgagttagcatttctcagaagactccttctgtctttgagctttccttaaaataccatgttttagtaccagtttcatgggtaagcttatattttgtggactttgaacctctgaaattcaaacaaatcctcattggatgtagtttttcgttgccatggaccaccaaagacttagatttaaaaggccattgtttaacctttttttgtaggacttccaaacttttctaggcaactcaatgctcacaaactaatatatttctttgttcttttctctgcattcttccaaaccactttcaatcatcctgatcattctgatgcccattttcttatgaaagttcctcttcctgctatattaattccttaatcaccatttgaaatgacaagtgactttttatacttaaaggcttaaaggtcatctgagctactacttttaggagaactcgatacatcgtaacctaatgtggttgtggaggttgcacatttcaaggcatcactttggagagggtgccaatcacatcatggttatattaatagtatttttgaatattttgtaattttctgacaaatgaaaatgaaatgtcctgaggaaggggtgtctttttctgtttcaccaaagagatgcatcccagcagcacaagggtcctggcttggcaattcatattcacaaatccattttcataactcataactgtgtgtttctcatcaaaatggacaatttggacattttagtaatgaccatttggattgttttcctagttgttcttctaaggtaatttttatttattcatcatgttacatacatcattgtagagaaatgttcttatgaccacaatttatccaatctgaaatttcatactctagctagaggagatgggcaggtatgatatcttcaacttaattgcattacactgaaatttgctttattaaaataaaatcacatagaacacctttttctacaagtcagaagactggagttctgtttccatctctgccacttaatagccatgtgaactttgctaagtcatataaatctccctaagccttttatttcatctgtaaaaagagtattaataccaattaacaataagacatgtctggtatacctcatagggttaatttaatggtcaaaatccataaatggtctttattgtcatggtcaaattgaaaatcattgaaaagtattaaatatttttaaaatagtgtattatttgtcttttttctcagccagtatttaggtttgtgtggtatttgaaaaactagaaagaaagagttgatgtgtgaagagtctccttaaaaaggtaggccttacagccatcagtgatatgggtttgttcttggtggcctaatctgcagtccttcagacacttcacaggtggttgtccattcacccaactgctggcttttgagtttaaaccttagtgatttaaaggtttattttcaagttgcagaacatttcctctatcttgatacagttttctgtgttgcagatagtaaatatatatgtagcttttgtaagactgcttgagggagtgacttttgatctttaaaaaactgtatgtttatgcaaagtaactcttaatggcctttggacaatctagtagcctaactgcacacaggaagtacagtagggttgcatgtgctctcaggctctcagaatggcatttagaaaacacagaccagggagacagctggtaatgaaagagcaatgagattgtatagcccctgtgcctggaagcagaggcacagcttggctttgataaatggagaaggaatgaaggaaggatcctgcagtctcttggtgtgacatgctactgaaattcagaatcatggccttgcctacacaaggactaacaataatcatgtggccaaaatacagaatgaaaataggctaacctgtagtttgggcctaggtgggcagccctaagtgagtctaagtcaaagggattcaaagttccaggaggaaaatgaattaattgcctttcccttcctccctggagagagtatccagcttgaacaaggctcctggaaggacttccatggagtgataaaggaggacaggggaactcagccacacgagccagctggagggaacaaatcgtgggaagccaagagataccagaggtcatatgtagtctgtccttccatcttggagggcctaaatggaaaaaatcctcaatattaaagaaaagggaaacttggtggtaaaaaggtatgatcagatgaatttttatcttgaattttttctaggcctttcagcaacagaaaagagcagatcatattccatacagttatttgtcagagggttgtactgttgtttccttcctcttctttttttcaggtccatggaaataaaaggcacatgaacaagtgcattctctctcttagagaccttaaagtggctgttgttgaggaaatacagtgcctggtacaagaactgaagaacattcagtcgactcttcacatatccaagcacatacccattcccaaaattcctcagatacacccagaagaagttccagaaaagagatttcagtatgatgaagaaactctcctaaattttaagcaacagcaaatgaaaagtaaagatgaaaagtcccccggagtggaacagacagggtctggaggcccagttggaggattcctcaaactctcttctagaaaggatggggatttgacaacccgtgattcaatatctagatcatcaaaggcatcaacattcagcctagatataccaaagtgtttggaatttgaaaaagcagagccaacggatgtggagctggaaattatgaagagagacgagattaaacacgtgtacatgcaacagtatttggtcaacagggtaaggggtgaacctgttcctagttaaagctgaaagagagaagagaagggaaaaaattgggtcgggttttttgtttatttatttaaaatttctctgcatgaacctttcccaaaccctgaccagcttaccactcagtgatggcttggcttcctccccatccttggccttctggaaatcactgtgctcttcccagaactacagagcttttaaacttttttttttgttttggaaagctgacaaagaatgaaggggaagcccatgtttcagttacttggcatctaactgaagtcatcgtaaaggggaagtggaggagcagcttttagatgatggatggaacatagataatggatggaacatagctaagaattttccagagaaacagggcaccctctgcttttcacaccatcctttttctctaatatgtggtttgttccattagtagaagtgtttatggtgattactgggtttgagattgttctggagctggaatggcgactattcttatttctaggaaattcaggaccagactagggcctgttgggcaggatgttctttgaatatgaaagaataacctttcttggatagataactctctgctgtcagccatgtagattccctttcctcagtgtgtctttccagcttcaccctgtggtgatgccctcagtagcttcccagccttattcttcaccattatctcttctttgtccagccctgttttctcactgttcttgcctctctccactccaccttttcctcccacaccattctgagttttgcatctgtgctttttcctttgctgtttccttctaccagtaatgacttccttccaccagtaatgacttccttccagagttgagttatcattcaaagcatggctcagttccaaaccctctccagcattttccgcccacattacttatgctgtccttgtttctaaactccagttgcacctgtaataagcatctcatgttttacactaattttccttgctgtttcatgggtattagtattgtcttgaaaattaaattacacaattcttgagcaaagggccacatatacttctgattcctccacatagtctaggacaatgtcaaacatataatagatattcagtcaaaagttttgattgatttaattgtaactaatttattaatttagcaaatatttattggatgttctgtatgcagggacactgatagataggattagggatacaacaattcttaagaaagacatgttctctatcttcacaaagcttataggctattgggattggagagaataaaacaagtgtaatccttacagacttggagacctatgtggtcctccaaataaatgcaggaataattcaagtttgttaaacaagctttaaaggggagcccaaacatatagtctatagagatggttacttaaaagtttaattttttcttctctctctgttttttttttttttttttttttttttttttttaagctctctaaatttctctggtagtttcactgctccaaacccacagatctctttctctcctcagccccagtctgggtcctcacttactataggcttttgacagttgaggccacctatcatgtacaaactaattaaaaacatagaatggtttgtctcttcctattgttccagtttcctcaggagaatcagcccttggggctctctcttgacctcttcatctcctttgtgatactgggggggaaagctgggggaaagctgtaccaaaatcagaacaaaactgaggacttaaaattagtaggaccataatggattaaagtctggaccaggacttgggatacttcggctcttatcaggaaaagtaactttgaccttaatttcttcaatcttagaaagagattgaacaggttttttgtggctccatgattattttatctatttaaaaatatttaccattctgtggttttgaaaattttcaacataagaagttgggaaacgtatttatttgtgcttactatataaaagggattgtagagatactatggagaataaagaggagacagatagaaacactacccactcagagagctcataagctacacagtaaagcaagaagggcattcttgattgatggcttagttaatggtgaagaaataggtggaaggacttctagttacacaattcctaccacttaataaattaatttatgtaaacttaatgccattaatgaatttatttttgtgactatacacacacacacaattctccatccataagggcataataaaaaatgacttcatacaaattagtactgttagatagtttaaaaatgcatttatctagtcttctaacgtatccgcaaatattttttccatctcagatcaaagaactggttgtcactttcgatgcagaactccgtctccttagacatcagaaactaaaactagatactcagatgaaattatctgacctgcaccatgtcaccttatttcaagaaatacttctcctgaagaattttgaaaaacaggagaacatacttcaagaacgtgttaattccttagacaaagaggaacagtacatgcaagtatgagtgggcagaagaatcctagctggctggtcccttagttatggagaaacttgatttctttttcttcttaactcaaatctcccacttgttctagcccttatctctttcttgtcttctttccccctcctcctttttcctgttattcctacctagtctccatctttagtattcatggtcaaagagaaatgattcagattttttagtaaatttggtctgatattctgtaaggtagaagaataaaattttcacaagttagcctttgattgtgccactctacaccagtctggtgagttgggttccctaaaaaacaaaaaagtaagctatgatataaaattgagttttgattatatgttatccttatgaaaacaactgaaaaagaagctggtgagtttcttaagtatgacagcttcagtgtaatatatgattgaatatcataagaaatgaggttcctttatttgttatatttgtatattaaatttcagaaaataaattatactagctttgttttaaaataagaaagattctattaaacagatagtatatgctaaatagtaacattcatttttaggtatattagcttcactagaaattatatgtctctttgttttagttatatatcaatacaaaaaattcattggtttttgagactacacatgcaaaaatattagctgacatccacatattcaatttaaggaatttcaaggaaaagtttcaatttaatttagattttggggggatgcttagcactaaaaagctgattttctaattctaaacatgactgatttttacaaaggaattataaaattttaaccaataaatggatggctctgcaaacatcagaaatgtaaccttcttttaagaagttttaaaaaatatatttgtaaactgtaaccttgtattgtaaagtacattgctctctgaacttggtttatcagaaatatttatcatttgtccttgtttttattcatttagtggaaaataaatgaaactcttaaagagatggaagagaaaaagaatgaaatcaccaaactccaggagcaagaaaaggcactctatgctggttttcaagcagccattggagaaaacaataaatttgcaaacttcctcatgaaggtcctaaagaagaagattaaacgggtaaagaaaaaagaagttgaaggagatgctggtttgtatttctttcttgcatatgatcttattttctctcattaacatgaaatagagaggtaactaagggacctattagataccttatttttttcactataacatggacaatgtagagacactgtgggggctaaagaggagaagacataaaccttagggtcttccaacacctcgagttaatctgtgtgcatgtttgtttgcacatgtgtgcacatgtttatgtgtatctggtatgagtgagcatagtgtagtttaagttaataagcacatctttttatgtgtttatttgccatatgtatatcttatttggtgaaatgtctccttttgcccatgtttgaataggatcatttgctttttttactgttgagtttggagagttctttatatattctgtatactagtcttgtgtcagatatgtggtttgcaaatattttttcctagtgcgtagcttgccttttcatttactgtagtatcatttgttgaaaaggttgtctctcttcgactgaattgctttgatctttgtcaagatcatttgggcatctttgtgtggatgtatttctaggttctgttacattgatctatgtgtcaatattttcaccaatactacagtcttgattattgtagctacatattgagcccttaaatcaggtagactaactcctcctactttattcttcttttgtaaaattgttgtagctattctagttccttgatatttccgtattttagaataatcttctttatatctacaaaaaatcttgttggaaatttgatagtaattgtgttaaaactgtatattaacttggagacaactggtatctttactacattgagttttccaatggaaagcacaatatgccgtagtccgagctactagggaggctgagacaggagaatggcgtgaacccaggaggcggagctggcagtgagctgagatcatgccactgcactccagtctgggcgacagagcaagaccctgtctccaaaaaaaataaaaaataaaaaaggcacaatatatctctatttatttagaacctcggtttctttgatcaaaattgtatactagtattcagtatataattcatgttcatgttttgttagatttacacctatttccttttttagtgatttttttttttttttttgagacggagtctggctctgtcacccaggctggagtgcagtggcgtgatctcggctcactgcaagctccgccctcgggttcacaccactctcctgactcagcctcccaagtagctgggattataggctcccaccaccacgcctggctaatttttctatttttagtagagacagggtttcactgtgttagccaggatgatctcaatctcttgaccttgtgatctgcccacttcagcctcccaaagtgctgggattacaggcatgagccactgtgcccggccccttttttagtgattttaaatgatactgtatttttaatctcagtgtcctcatgttcattgctactaatagatttttacatgtttagctgatatcccgtaaccttacttattagttctaagaggttttgatagattccttggggatttctatgtagatgattaggttggtgcaaaagtaattgtgggttttgctattaataatgggaaaataatttcacctaataatttcgtctgcaaatataggcagttttatttatttatttctgatcaggatgcctatttcattttctggccttattgcatggctagaacatccagtactatgtgagtgctgaaagctgacattcttgctttattttcaatattaagtataatattacctgtaggtgttttatagatactctattaagttaaggaagttcacctctgttcctctttttcatgaatttttttcgtgaatgggggtgaaaatttgtcagatgcctgtctacattgattcatgatcatgtaattttctttttagcctattaatatggtagattacattggctaattatggattattaaatcagaattgcatttctgaaataaaccttccttggcatagtgcaaaattctttttatatattgattaattctatttgctaatatttcattaagaaattttttgtctatattcatgaagatcatttttctgtagttttcatttttggtactgtctttgtctggttttagtatcagggtaataaaaactagcttcttaatatgaatcagaaaattttcttttccatttgattttctggaagatcttgcatggaattggtggtaattattctttaaacacttagtagaattcaccagtgaaagcttttggatttgaacatttcttttgggggagtttttaaattacaaattcaactttcttaatagttatagggttgttcaaatgatctatttctctctttttttttttttttttgagacggagtcttgctctgtcaccaggctggagtgcggtggcgcgatctgtgctcactgcaacctccacctcctaggttcaagcgattctcctgcctcagcctcccaagtagctgggactataggcacgtgccaccatgcccagctaatttttttgtgtttttagtagagacgggatttcaccatgttggccaggatggtcttgatctcctgaccttgtgttccaccggccttggcctcccaaagtgctgggattacaggcgtgagccactgcacccagcccaaatgatctatttcatattgggtgagtcatggtagtttgtggttttttgaggaattggtatatttcatctaagatgccaaattaatacatgaatatccttatctttttagtgtctacagggtctgtagtaatatcacctgttgcattctttttttctaaaaaaaaattcagcttttattttagatacaggcggtatatgtgcaggattgttacattggtatattgcacccaggtagtgagcatagtaccaaataggtagtttttcagccaatgcccccctccttccctcaccactctaatagtctgcagtgtctgttgttcccgtgcttatgtccatgtgtgctcaatgtttttagctctcatttacaaatgaaaatatgtagtatttggttttctgttcctgtgtgaattcgcttaggattatcacctccagctccatccatgttgctgcaaaggtcatgatttcattctttttttatggctgtgtagtattcaatggtgtatatgtagattttctttgtccaacccaccattgataggcacctaggttgattccatgtctttgctgttgtgtatagcacagtgttatggtttggctgtgtccctaccgaaatctcatcttgaattttggtccccataatccccacatgtatgggagggatctggttggaggtaattgaatcatgggagtggttaccctcatgctgctattctcatgatgagtgagttctcatgagatctgatggctttataaggggcttccccgccgccaacttcactctgcacttctccttcctgctgccatgtggaggaggacatgtttgcttccctttctactgtgattttaagtttcctgaggcgtccccagccatgctgagctgtgagtcaattaaacctctttcatttataaattacccagtcttgcatatgtttttattagcagtgtgagaatggactaatacacatggcaatgaacatgagtgcatatgtctttttggtataatgatctattttcctttgtgtatatacccactaataggattgctgggtcaaatggtggctcatttttaagttctttgagaaatctccaaactgctttccacagtggctgaactaatttacattcccactaatggtgtataagtgctcccatttctccatagcctcaccagcctcttttttgactttttaataatagttattctgactggtgtgagatggtgtctcattgtggttttgatttgcacttctctgatgattagtgattatgagtatttttttcatgtttgttgcctgcttgtaggtaatcttttgagaagtgtatgttcatgtcctttgcccattgtttaatagagttatttgttttttgctatagattctggatattggtcttttgttggatgcatagcttgtgaatattttcttccattctgtaggttgtctatggctagccagttatcccaacaccatttatcaaataggaacttctttctccattgcatgtttttgtcaaccttgttgaagataagatggttgtaggtgcacaaccttatttctgagttttctattctgatcttgcggtctatgtgtctgtctgtttttgtaccagtactgtgctgttttggttactacagctttatagctgaagttaggtagtgtgatgcctccagctttgtggattatctttaggattgcattggctatttgggctcctttttggttccatatgaattttagaatagtttttagttttttctagttgtgtgaaaactgatgttggtaatttgataggagtagcattgaatctgtatattgctttggaggatatgccattttaatgatattgattcttctaatctatgagcatgggatgtttttccatttatttttgtcatctctgatttctctcagcattgttttgtaattctccttgtagagatctttcacctctttgattagctatgttcccaggtatttcatttttattgtcactattgtaagtgggattatattcttgatttgattttcagactgtacattattgatgtatagaaatgctactgatttttgtatattgattttgtattccaaaaccttgctaaaaatatttaccagttgtagtagcctcttggcaatctttggggtcttctaagtatagaatcatatcaccagcaaagatagttattttgacttcttttcctatttagatgccttttatttctgtttgttgccagattgctctggctaagacttacagtactttgttgaatagaatggtgagagtgggcattcttgccttgttccacttctcaagaagaatggttccagcttttgcctattcagtatgatgttggctatgtggatttgacatagcgctcttattattttgaggtatgtttcctcaatgcctagtctgtcaaggatttttattatgaagatatgtttgattttcttgaaaactttttctgcgtctattacgatgatcacatggtttttgcttttaattctgtttatgtggtgaatcacatttactgatttacgtatgttgaaccaatcttgcatcccaggaataaagcctgtttgatcatggggaattaactttttgatgtgctgctggatttggtttgctagtatgttttgaatatttttgcgtctatgctcatcagagatattagcctgaagttttctttcttcatcatatctctgccaaaaaattttgatattaggctgatgctggtttcatagaatgttttagggaggaatccctcctgtgatggtgagtgtcaacatgattggattgaaggatgcaaagtattgatcctgggtgtgtctgtgagggtgctgccaaaggagattaacttttgagtcagtgggctgggaaaggtagacccacccttaatctgggtgggcacctctaattagctgacagtgtggctagaatataaagctggcagaaaaatgtgaaaaaactagactggcctagcctcccagcctacatctttctcccatgctagacccttcctgccctcgaacattgaactccaagttcttcagttttggggcttggactggcttttcttgctcctcagcttgcagacagtctattttaggaccttgtgatcatgtgacttaacacttaataaactccttaatacttaataatatacatctagatatatataacttcattatatatacatatatataacttcattatatatatacatatataacttcattaagtactgtatatctagatatatattacatctatatatcatatatatcatatatgatatatagatgtaatatatatcatatatatcaatatatatcatatatatatcatgtatatatctgctccatgttcttgagctgtgcaccacagccctggagacactgggatatcttgagattcagggtcagggtcagggtcaggttccagctgcactgggggatctgatttgctttgcagttgccagaacaaatatagatctatatatattgagagagagagagagagagagagagagagactaatatacctcctcaattttctggaatagtttcagtagaattggtaccaattcttctttgtatgtctggtagaattcagctgtgaattcatctgatgcagggctttttttcattgttatctattttttatgactgattcaatttcagaattcaatattgttctattcactgttttaatctcttccttattcaatcttgggagattatgtatttccaggaatttatccatttcctctagattttctggtttgtgtgcatagaagtgttcataatagtctcagaagtgttcataattagtctctgattatcttttgtgtttctgtgggatgagttgtaatgccatctttgtcatttctaattgtacttatttggatcttctcattttcttttctttgttaatctaactagtgatatagcaatcttgtttatttttttgaaaaaaacctcttggtttcatgaatcttttgtatggatttttgtatctcaacttcattaagttcttctctaattatagttatttcttttcttcttgctttatgaccaagcatgtggtcaatcttagactatattctgtgtgcagatgagaagaatgtatattctaagttgttggattgagtgttctgtagatgcgtattaggtccaattggtcaagtgttgagtttaagtccagagtttttttgttagttttctgccttgatgagctgtctaatgctgtcagtgggatgttgaggtctcacactattattgtgtggttgtctaagtctttttgtaggccaggaagaacttgttttatgaatctgggtgctccaatgttgggtgcatatatatttcggatagttaagtcttcctgttggattgcactctttatcattatgtgatgctcttcattatccttcttaatttttattggtttaaagtctgttttatctgatataagaatagcaactcctgctctttttttgttttccatttacatggtagatctttctccatcctttcactttgagccaatgggtataattatatctgagatgggcctcttgaagacaacagatggttggttcttgtctttttatccagtttggcactctagcttttaagtggggtgtttagcccatttacattcaaggttagtattgatacgtgtgatttttgatcctgtcatcatgatgttagctggttgttatgtagacttgattttgtagttgctttatagtgcctgccagctgtgtgctaaagggtattgttttttttttgtttttttttgtttttttatttttgagtccatgtttaacactcccttaaggacctcttgtaagactggtctagttgaaacttattccctcagcatttgctttactgagaaggattttatttctccttcacttatgaaacagtatggcaggatgtgaaattcttggttcgaatttattttctttataaggacactgaaaataggcccccagtctcttcttgcttgtaagatttctgctcagaggtctgctgctagcctgatgggtttctctctgtatgtgacttgacccttctctttagctgcctttaagatttttttcttttgcattgtccttggtgaatctgatgactgtgtgccttggggtggtcatcttgtatcatatctagctggggctctttgtatttcttgagtttgtatttcaaactctctaataagattagggaaatttttgtggactacattctcaaatatattttccaagttgcttattctccttctttctcaggagtaccaatgagtcatagatttgttctctttgtagaatctcatatgtttcagagatttggttcatttaatttttttctttacttttgtctgagttgattcaaagaagcattcctcgaactgagattctttcctcatcttagtctattctgctgttaatattccaatcatattatgaaattcttgtagtgagttttttagctctaggagttcggttttcttttttctgaaaatgtttaaaaactttaaaaatttggttttcttctttcttatttcatctttcggctcttggatcattttactgaatttcttggattgggtttcaactatctcctgaatcttgatgagcttccttgacatccagattctgaattttatgtttgtcatttcagtcattttagactgttaaaaaaaaaaaccagtagtggccagtagctgcattaatacccagctgcacagctctttagtatttcctagtgtttgcaggtgtgttctgaagtaggggtgagggagtgggagagatggccactcaccaggtccactcctgggccttgggggagccccctccaatcactggcactgtgcctgtgtttttgttgttgttgggtgttccaggccatggggcccccttgcaaaaagactgtagcagggagatatgcaacatcttttctggactggccctgcaaaggaagaaagccccattctcaccccagcccaggaactcatgcatctcacccctctcaatactctctgagagtgagggctcctccccagctcaagtgctggccatagatcttggctccatgctcttgagctgtgcaccacggccctggagacactgggatatcttgagattcagggtcagggtcaggttccagctgcactgggggatccaatttgcttcgtggttgccaggaaactactcaggtgcagcaatgcactcaggctgggctgcaaaggctgtgttgtatagctgctcctgcagggcggtgaggcatgggccccggcagtgactggcaggcaggagggcttgcagagaagatgtgccccagtcccaaagggaagccggccctgctctctcctggcttggaggtcagctggagcccatgcctcccagagagggacgaggaactctgggggatgagtgtctatggccgctctctgtcagagctgcccaatgcacaaaggcactcgggatccatgtcatctgaaggccagtctctgcctgctccctggggagatccccctgccaggtcacacatccatgggagtcatggggtcccctatagccaggattccagaggtctgtggtaagagtgagccatccctcagttctcttactcatccctttcccagtagctgtttggggagagccttggtgtttggttaccccgttcagggttcccagcttctttcctcttcagcctcaccttcgctgttgcctctcaattcactcttggcattttctctctggagacatttttaaattatggtggtttactccataatttaggctctctcagtgggagtggcacttcctggctgtttctagttggccatcttgtctgtttgtcctgttgctttttttttttttttgagatggagtctcgctctgttgcccaggctggagtgcagtggcgtgatcttggctcactgcaacctccgcctcccagattcaagcaattcttgtgcctcagcctcctgagtagccaggattacagacacccaccaccacacccagctaatttttatatttttagtagagatggggtttcacagtgttggccaggatggtctcaaagtcctgacctcaagtgatccacccacctcggtctctcaaagtgctaggattacaggcgtgagccactacagccagctgtattcttcatattggtaacttgtgtctttttttttcagtctggctagaggtttgtcaattcaactgatcttttcaagaacaaatcagcttgtgttataagggattttctttattgtttttctccttttaatttcattgatttctgctcttatctttatgattacattttttcctgcttgcttttggtttattttatacttccatgtttaggttttgttgtgggagtttagattattgatgatatttttcttcttttctaatttagtgctataaattccctcttaactctgctttggctgcatctcacagattttaagttggatttttaattttcactctggtcaatgtagtttttaaaatttttattgagacctgctctgtatcccatgaattgtatagaaatgtgttgtttagtttaaagtgttttggaatttttctgttatctttctgttattgatttctagtttgatttcattgtggtcggagaacatattctgtattatttcaattcttttgtaattgttgaggtttgttttatggtctaacatatgatctatcttggtatttgttctctgggcacttgcaaagaatatatagatgctccttgatttaccatggggtatgtcctgataaacctatcttaaattgaaaatatcacaagtcaaacatgcatttaatacacctaacctaccaaacatagtagcttagcttagcttggcttcagaatgctcagaacacttatgttagcctggagttgggcaagatcatctaaaacaaaacctattttataatcagctattgaatatctcatataatttattgaacatagtactgaaaatgaaacagaatggctgtatgagtacttgaagtctggtttctaccaaatgcatattgctttcacaccatcataaagctgaaaaatcataagtcaaaacgttttaagtcagaaactgtctgtatattctgctgttttgggtggagtgttttaattactgtcatttaaatcctgttggttgttgatgctgttgaggtctcttacattcttgctgcttttctatgtagttgttctatcaaatgtttagagaggggtgttaaggtatctaaatacaattgtgggttatttcatttcttcttttatttctatcagtttttgcttcaaatattttacagctctgttgttttatgcatacaaatttaggagtgtcatgtcgtcttggtaaattgacatttttgtcattatgtaaggtttctttctgtttctggtaattttctttgctctaaagtctatttgtctgacattaatatagctgctcctgctttgctttgattaaaatttgtataatatttctttttccatctatttactttgaatttgcttgtcattagatttggagtaaatttctggtagtcagcgtatgattggataatgtttttcattcaccctggcaatctctgtcttttctttggtgtatttaaaccatttacatttaatacaattgttggtattttagagcttgtctgttatttaatttttattttctgtttatgttctctgttttcttttataaaatttttcctgctttcctgtgggttacttgaatatttttggggattctattttaattttttgtagtgtttttgaatacatctcttcgtataactgtttaagttgttgctctttatatttcattatatatacataatttatcccagtctaccaatgtcatcatttatcccagtctagcaatgtcatcattttgccatcattttacatcattttaccagtttaagtgaagtacaaaaaccttacttaccattacatccctttaccctcccccatttataatatacttgtataaatatttcctctccatacatctagaaccacattaagtaatgttatatttttgcttcagtcatcaaacataatttaaacactcgaagagaggagaaaagcctgttgtatttacccatatttttgcttatcatgttcttcttttctgatgttccaagttttccttcttttattgtttgctttctgtttagagaattttctttatccattattttaggataggcatgctggtgacaaatgttcttatttttttaaaaaatcagataatgtcttaatttttccctttttgaaagacattttcacttggtatagaatcctaggttgacactacttttctttcagcacttgaaaaatcattgtgtcatttcctttcggcttccatggtttctaatgagaaatccattgctatacaagttgtgtatcccctatagttaatgtgtcacttttctgttgatgctttcaagactttttctttgtctttagttttcagaagtttgattgtgatgagttttggcataaatttatttgggtgtctcctgtttggaattcaaattccttagcctgtcttttgtcaaattagggaagttttcatcctcattctctttcttcactccttctggtactctgatggcataaatattagatctttcattataatccaaaaggtccctgaggctctggggttttattttgttttgtttttgctcttttctttctgtttttcaaattggatgatgtctattgttcagtctttacatttattgattctcttctgtctcctttctattctgctgttgagttcattcattgagtttttatcttggtgtattagtctgttctcacactgctgataaagacatactcaagactgggaagaaaaagaggtttaattggacttacacttccacatggctggggatgcctcagaatcatggtgggaggcaaaaggcacttcttacatggtggtggcaagagaaaatgagaaagatgcaaaagtggaaacccctgataaaaccattagatcttgtgagacatattcactgccatgagaacagtatgggggaaaccgcccccatgattcaaattatttcccaccaggtccctcccacaacatgtgggaattacgggagtacaattcaagatgagatttcaatggggacacagagccaaaccatatcattccgcccccttgcccctccaaatctcatgtccttacatttcaaaaccagtcgtgccttcccaacagtccctcaaagtcttaactcatttcagcattaacccaaaagtccacagtcctaagtctcatctgaggcaaggcaagtctcttctgtctatgagcctgtaaaatcaaaagcaagctagttacttcctacataatatggggctacaggtattgggtaagtaaagccattgcaaatgggataaattgaccaaaacaaagagattacagggcccatgcaagtctgaaatccagcagggcagtcacattttaaagctccaaaatgatctcctttgactccaggtctcacatccaagaggtgggttcccatggtcttgggcagctctacccctgtggctttgcaggatacagcctccctcccagctgctttcacgggctggcattgagcgtctgcggcttttccaggtgcacggtgcaagctgttggtggatctaccattctggggtctggaggacagtggtcctcttctcacagttccactaggcagttccccagtagggactctgtgtgggggctctgaccccacatttcccatccacactgccccagaggttctccatgagtgccccacccctgcagcaaacttctgcctgggtatccaggcatttccatacatcctctgaaatctaggcggaggttcccaaacctgaattcttgacttctgtgcactcacaggttcaacactatgtggaaactgccaaggcatgaggcttgcaccctctgaagccatggccccacctctatgtttttccctttcagccatggctggagtgactgggattcagggcaccaagtccctaggctgcacacagcacggggaccctgggccctccccaagaaaccattttcttctaggcctccaggcctgtgatgggaggggctgtgtgaaggcctccgacatgccctggagatatattccccattgtcttggggattaacattccctacaacaatggggaattaacattcctcaatttacttatgcaaatttctgcagccagcttgaatttctcctcagaaaatgcgtttttcttttctatcacattgtcatgctgcaaattttccaaacttttatgctctgtttccgttttaaaactgaattcctttaggctgggcggggtggctcatacctgtaatcccagcactttgggaggctgaggtgggcggatcatgaggtcaggtgatggagaccatcctggctaacacggtgaaaccccatctctcctaaaaatacaaaaaaaaaaaaaaaaaattagccaggcatggtggcgggcacctgtagtcccagctacttgggaggctgaggcaggagaatgatgtgaacccaggaggcagagcttgcagtgagtggcaatggtgccactgcactgcagcctgggtgacagcatgacttggtctcaaaaaaaaaaaaaaaaaacacacacacacacagacacacacaaaactgaatgcctttaacagtatccaagtcacttcttgaatgttttgttgcttagaattttctcccgccagacaccttaaatcatctctctcaagttcaaagttccacaaatctctagggcaggggcaaaatgcccccagtctctttgctaaaactaacaaaagtctcctttgctccagttcccaacaagcttctcatctccatctgagaccacctcagcctggaccttattgtccatatcactatcagacttttggtcaaagtcattcaacaaatctttaggaagtcccaaactctcttacattttcctgtcttcttctgagccctccaaactgttccaacctctgcctgttacccagttccaaagtcgcttccatatttttggatatctgttcaacagcgccccactctactggttccaatttactgtattagtccattttcacactgctgataaagacataaccaagactgggaagaaaaagaggtttaattggacttacacttccacatggctggggatgcctcagaaacatggcaggaggtgaaaggcacttcttacatggtggcagcaagagaaaatgagaaagatgcaaaagcagaaacccctgataaaaccattagagctcatgagacttattcactaccatgagaacagtatgggggaaactgcccccatgattcaaattatttcccaccaggtccctcccacaacatgtgggcattattggagtacaattcaagatgagatttcagtagggacacagagccaaaccatatcacttggttattgtatttttcagttcttaaattttcacttagttctttataatttctatttatttgctgaggctttgcattttttcatttccttcaagtatgttcaaattttgctaatggaagcatttttatcatggctgttttaaatactttatcagataattctaatatctctgtcatcttagtgttgacagctattggttttcttttttcactcagttggagattgcattagtccattcttgcattgctataaagaaatacctgatattgggtaagttataagaaaagacgtttaattggctcatggttccacaggctataaaggaggcatggcagcacctgcttctggggaggccttagggagctttaactcacatcagaagccaaaacaggagcaggcatcttataatgcaggtgcaggaccaagagagtgagagagaaggcactacacaccacacttttaaaacaaccagctctcatgatgactccctcactcactatcatgagaacagcactgaggggatggtgctaaactattcgagggattcctccctgatgatccaatcacctcccaacaggcccctcctccaacactggggattacagttcaacatgagatttggtgggaacacagatccaaaccatatcagatatcttcctggtttgtggtatgagtgacttttaattgaatcctaaaaactttcatgttgtattatgagactttgtatcttatttaaattttctgttttactcaaatttctcaaacactaatctgacaaggaaagggatgggagtctccttactgttggtggaggtagaagtctatattccccattcagacttcattgtcacccaagggatagggggcctctttgatactgctatgtatgggtgtgggttccagctccacatgtagtttctgtgatcaacatcgtggggatggcaagtacttatggataatgatgaaagtcctgattctctattaatgttcttctgataccacccctgaggggagaggggagagtaccttattactgaccttgggagtggaagtccaggctatcacatggcctccacaggcatcttggtggtgagggtgggggtgaggctggttaccagccagcatgaataaatgtactggctccctgcttgcccttctctaacaccatccagtgggagtgttgggacacctcgttacagccctgtgagggtggatgtctagcctctccacttaacctttgctgatttagttggggattgtaccagagtttttctgtggtgtttggttggaatagaagagttactgtctaaaagttttctctcctgctaggctgccccttccctggtcctttggctagagagagcaagcttttgttgaggctttctgtgtctatagatctgttggtgtttctaggctgccaacttattcttctccaagtctgaggtagatgaggctaaaagaatatccaaggaactcgccacagtgttgttcctcaggttctaaggtgcatagttgctctactttcttctctccattttttcagagtcttcttatgtttgttttgcatataatgtttagttgtatttataaattgtaaattggtgatctgtagttcatagatgacctcagggtgttttgaaagaaagtggggcaggttggagtggaaaggtctacaaccccttatccaaaacccttagggacagatgtatttttgtgttcagaaatatttctgaagatattatatatgatatgatattataaataaatcattcctgacacttattaaaaacaataaggcagactttattcaggggggctactataatggggttttgtagcagggaagagagatggggctgaactctgaatacaacaaggacaagtggagatttatagccaaggaacagagtgggcgtcagtggacagaaaattactaagaagtagggtaattcttctctagactgttttaacaggacttttgctgagggcaagccaggtaataagataatacaggtggagtgatgaggaatttgatcagatatcaagttctctccattgggagaagtgggaaattttttctaaattaacttgcaggattcttgctagaattggactaaataggttaaggacacagctcaaggtcaggaactagtcagaaaaaggactcagagaagcctgactcaagtggggtcaaaggagagagtctttgtcaacatgataccactagcaagttctggtacagaatcccaaaatcaaacatcttagtacttctgcagcaaaacatgaatattcataccaagttaaataaagactagaaatgtcattactttatttcagataacttatgaaaatcttttcagggccaggcacagtggctcaagcctgtaatcccagcactttgtggggcccagttgtgcagatcccttgagcccaggagttcaagatcggcctgggcaacatggcgaaaccctgtctctacaaaacaaacaaacaaacaaaaaccaaaaattagctgggcataatggtgtgtgcctgtaattccagctactcagaaggctgaggtgggaggattgcttgagcccaggaagtgaaggttgcagtcagccaagattgcatcactgcactacagcctgggcaacaaagccagatcctgtctcaaaagaaaaaagaaaaaaaaaagaaaaaaaaatttttgtctgattttagagcatcttatgagttaggaattgtgggtctgtttcactaactgtgttttaggtggactacaacatctgcagcttgggaacttggtctcagcctctgacttgcattgatagtaactgcacaaccctctgcaggcatttgggtttgtgttctttgtgtccttaaccattttaaactcttatattgagttatttttctagtgactaactcattgaaaaatagtttactttaaaaatctagtatttagtttaatatagaagcttctttgttaacaatgccctcctctttccatagatgaagatgaggagagtgaggaatcaagtgaagaagaatctagcttggagagtgatgaagatgagtctgaatcagaagatgaggtttttgatgattctatttgcccaacaagtaagttagataaaaccacgtgttctctgtgaagtgtgaatattgattggcaatactgggaagaccctttttggtttctctgtgctctgataattcaaaaaaaggatagttcaaaatgtatgttatagagtctaatgaatacctttttttaagtgtaaggatatttatttatttttttgagacagagtttagctgtgtcacccagggtggagtacagtggtacgatctcggctcactgcaacctccacctcccgggttcaagctattctcctgcatcagcctcccgagtagttgggactacaggcgcatgccatcacgcccacctaattttttgtattttttttagtagagacggggtttcagggtttcaccgtgttagccaggatggtcttgatctcctgacctcatgatccacctgcctcagcctcccaaagtgctaggattacaggcgtgagccatcgtgcctagctaggatatttatttctttattcaataatattcaacttctactatgtgccaggcacttatctgatgctaaggatacatcaaagtataaaacaaactccttcatcctcatggagcttatagtctagtggagaaagacaataaatataagaagtcaattaaacagaatcttagaaggtggtacatactatgggaaaagaaatgaagggagtgcaggagtggggatggagaggcacattgctatttccaatagtatggtcagggaaaacattaatgaatacttttgggggctctctgggtgatttattatctgttctcttaggcagccatttatgagtgacaaataatatgcagacaattgacagttgattcagagttataagttatgtagcaagtttaattttatagagaaatgccagactgtaatttacatatatattttacaggaatctccctttttgacaaacctattcaaatttttgtgttgcagatctgttttgtaagggcattttgactagtttcctggaaatgcttgacaatttacattcactgttttcactggtgaaaccagtctggagcagccagaccaatttcttgcagtctcaatagatgaacggttcagtagagaaaaaacaagttttgggatctgtaatttgtttttctagacatttcaaataaagttttaattaaattttaaaagtttaatttcagataaagtttttatcttgttttacttttgaatacaatggtctttaaaaatcataatatttatgagtgaaatagagcacacaaacctaatgccaactcattattttttagcaggataattaaatggcttgaagaatgactcacagttagtatggtgatagcactagggctagatctaagcttcctgaattctattttagtattccatttctacattctctattacttggtggataaaggtggctcttagtgtgatattgtggaaataatagagagataatgcacttgaatcccattctgttatgtactggttatgtcacctctctgagacttaaggtattcacctatatatgggaataatagtttctgccttgcagggtctatgagccttgagtgagataacatacataaagggcttagcacaaagcctgcttcagagtactgctcacaacatcaatactattattattttatggttattagtaatactaataatttcaacctggaacaattaagccataagtgtcttaaaagctggctagagtggatccataaatagacattattgattctgaatctccaaagttcacaattttagtactaccacattccataacaaatgaggctggtttttattttaattctcttggcagattgtgatgtggctctttttgagctggcccttcaccttcgagagaaaaggctggacattgaggaggctttagttgaagaaaagaaaattgttgataacctcaaaaaggaatatgatacattgtcaaaaaaagtatggtgatctgtttacttatttatcctctcaaaatgctacacatcctcctagctataatattgcctttttatagcaatgacaatattaggacttctcagaaaagaaacatttcaaatgttaagggcaggtttttttctccctaaattgtggtgggggacattgcttttttgatcattggacttactttatgtcagtcattggtctccagacttttctgatgactgtataagtaaaaaaaatgaaaatggagcccctccccatacaataaatgtatatgtatttataaattgtatttatgaactattatgtatcttgtacaataggaaacatccacaaaaacagaaattaaatagaatgagataaaaataaatagaaatagaaactctgacattttcaatttataccccaatagatgattttgttgatcatctggggtgcatgcatcccatgttggagaccaccaatttctgccttaatctgctcactttccctcttaggtactcttgtctagagcaacatcacttaacttcattcatgttcagaaatatttttgatgtattatttctcctcttgcaaacaggaaatgatttggaaaactttcaggttttctaggacatggagaatgtgctttagaaatactatagttagcagtttcattgctttaaagcactgaaactttctttaatttgttgaagtcatgaccaaaaaagactcccaccattctgtcaaagacattccatgctgatgggctgcttttcatgcagaaaataaaagggagatgaggacatgtcttctgggctcttattcacaaaactttataactctggagtcatagaaatgactgaagagtgatgtggatcataacttggcagaaagaaaataatatgcattcctgagttgcaaactgggatcatgcacttaatcacagcccaacaaagcagattctgctcatgctttacttcctcccaagatgccttcattcaccatctttagatgtatgtttattgagtcttgtcaccatttcacaacacggggctttctacaggtgaaaattgtggcaactaatctgaatgcagcagaggaggccctggaggcttatcagcgagagaagcagcagcggctgaatgaactgctagttgtgattccgctcaagctccaccaggtgatgcgtctggggaggctgctccatcctgtccgagaagagtcatcacacccaagcttttcagagaaagattcatagttcactaatggggagaatcgtggttctttgttgagaattccacctgtagaatgacacctacacttgtcttatccactgtcagattgttataaaagagtaacatcaaaacatggatatttccctgtggcccattagcactttggaaatcagtcatttcaagtctagagaaatgaggagcctatgatttaagaatgcaatggctcagagggtgaaatcttggctcttatacccatgccacttttcacaccatctttatctatacatggactaatcatgctaaaatgacctttgcttagtctctactcattggtgagggaggtcaggacaaaaggaaaatattttctcttttttacttttcttgttcatttctatttgaattgcaacttatattaaattgcaggaatacatatcattaagagaaaaggcttattgtattctcctttgtcaggttaagagaaaaagctgtattttaggaaaacaacaacaacaagatcagccttatatatgttttgtgtaacctgacccaaactggatgagctaaatggagcggtttgcctagtatgccagccctgaaatgtttgtcacatcattatgcagtagataataggcatgatctgtgtgggaggatttgctatccccacagagacgtgatgtggctttctgtctgacagcatctttctgtgtttgcctggctactgttactcagtaaggaagacgtagaagcccaaaggcaaggagctaaacaaggggcaaagaaggaagtgcacctcttatgctttctgttgccatacaaaatctgtgtttttgtctattttcttttgatttgttttatgcttgtagatagagtatgtggtatttggagaaatacctagcgatctttctggtactttggtcttctctaaccatgccttgagacggctgcaagaacgaatccatgagctccaggaggaaaattccaagcagcaaaaacttaacaaagaatggagagagagacgtaaacagctcatccgagaaaagagagaaatgacaaaaaccatacacagtgagtatctaagcccacagccttgctagtaaggtttattggtaagaaagggaattatccaggtgactgtctccaactgtgaaaatagtaattgcagactcagaaccactgagaagggaaacaagaacaccacaacatcttcctactcaccgtttctcctgatgccatgaaaagctcgctttcctgttttaaagggagaaatcttttgtcatagaatcatcttctctttgtgtatgattaaaatatagaataatacaataataacccaagtgcaagactacccaggttaagaaagaaaacgttgagatacaatcgaagccccatctctttctaatgcaattctgtggctccttcctcggggttcaccaccaggtatgcacacatacatatggatgtgtccacacacaatatggagacctaccttgcatatttttaactgtgcaaaatgatatttatatcattttgtggttcactttattaaaccaatttttaagttatccataaactacagatagtttattcactttactgctacaaaattccatttatgaatattaaatattttatttagcctcctattgatggatatttaggatatttattatttttcattattatagacaatgttacaggaaaccttcttgtacacatctccctgtgcacatgtgtgagaaggtgaatcctagtactgggtctctgggttacagagggatatgtacattttcagctctcctggatattgccaggttgcccccaaagtggttgaacaaatttctcctcccctagcaatgtgtgagaattgcccaggctccatattgtcatcaacagttgatattatcagactttaatatttttgccagcctgtgagatgttaaattacatttcattgtggtttttattcacattttttgattgctggtgaagttaaatatctttacatacatatatttgccatttatttattttattttctgtaacttgcctgtcctatcctttgtccatttttgatttctattttttgcttttaaattgattttagggagttcttaatatatcctttttgtccattgaatgcactgcaaatctcttctagtttgtaacttgtcttttttcttttctttttctttttttttttttttttttgagatggagtctcactctatcgcccaggctggagtctcacctctatcgtggtggcgtgatcttggctcactgcaacctctgcctcctgggctcaagcaattctcctgcctcagcctcccgagtagctaggattacaggcgcctgccaccacgcccggctcatttttgtgttttttagtagagatggggtttctccatggtggccaggctggtctcaaactcccaggtgatctgcctgccttggcctcccaaagtgctgggattacaggcgagagccacagtgcctggctatctttttttttttttttttttttttactttgtctagtgtatctttggatacagatgttttaaatcttaatatagtaatttttttaatcaatctacttatttatggtttgtgcactatgtgtatgtgtgtgtgtcttgcttaagaaatccattcctattttgaggtcataaagatattttttggtccaaccattccactactgggaaatgaaattagtaatcagtatgcagaagagacatctgcagtcctatgttcactgcagtattattcacaattgccaagacacggaatcaacctaagtgtccataaacagatgagtggctaaagaaaatgtggtatatgtacacaatgaaatactattcagccttaaaaaagaaggaaaccctattatgtgcaacaacatggataaacttggaagacaatatgttaagtgaaataagaggcacagaaagaaaataccacatgacatcacttatatgcagagtataaaaaagttaaactcatagaaacagaatagaatgatggttaccagggtctgtggttgtgggctggggtacagtttggggagatgttggtcacaggatacaaaatttcagtgagatccaaagaacaatttcaagagatctattgtatactatgatgactatagttaataacaatgtgttatattcttgaaaattgctaagagtaaattttaagtgttctcacaacatgaaaaagaaagtatgtgaggcaatgcttaagttaattagctcaatctatcaatctagccattccacaatgtgtgtgtatttcaaaacagcatgttgtatatgataatatatacaatttttgtccatttaaaaagatcattttcagtagtttcctaattagttgtgcccttcacatttgggtttttaacccacttaaaattgaggtatatagtataagatgtatggtataaagataattatcttttaaaatactttagtaatatttgatatgtggaacatacatataagcagtggagtattacaacagaatgaacccacccacccaacttattaacaatattattaccaacactgtaacatctatctgtgtgcattttttccatcccattctctgtctccccatattcagagatagccaccattcccaattttatgtttagcattccctttcattaaaaaaaagttatatttacatgtacttctaaataatatattgctttagaactttgtagaaatattacatcatatgtagccttttgaaacatactctcatttaatattatattcataagagtagacgtaatatagcatatagctgttgtttgtcttcattgtaaaatatatcatatgattctactaaaatgattcattcttctgttgacagtggacatttaaattgctttatgttcttttgctttgatgattctgctatgaaaattcttgtacatggtatatgtttacaagagtttctaaaaatataagggtttcatacctaaaagtagaacagctgggtcgtagggcatataagtgtttaactttttaaaaaatgttaaattatcttccaaaatgattacatcaatttacactccaatcagcggcacttaagagtcccctttgagctacatacatcattgaaaatacataatcttattagactttgaatttttgccaaactggaaagtataaagtggtaactcatggtcttaatttcattttcctaaccactaataaggttaagcacattttatatgtctttgggcctttaatgtttcctattctataaaatgtctgttcatgtattttgttcatttttctcttgatttgtttgcctttaaaaaaattgatatgtatgaatttttttttgatactaatcctttgttggttatgggttttccaaatatattcctttggttttttgttttcacgtttatggaggctttttaaagataattaaaaatttgttttcaatttttattttttgtgggtacatagtaggtatatatatatatatatttataagatatatgggatattcttatacagagatacaatgtctaataatcatatcagggtaaatgggatatcctcacctcaagcatttatcttttatgttacaaacaatccgattatactcttttagttattttaaaatgtacaattaagttattattcaccatagtatccctgctgggctatcaaataccagattttatttattctatctaactgtttttgtacccattaaccattcccacatcccccacctccactatccttcccagactctagtaactgtcattctactctctatctccatgagttcagttgtttaaatttttagctctcacgaataagggagagcatgcaaagtttgtctttatgtgcctggcttatttcacttaatgtaatgacttcagatccatacatgttcttgcaaatgacaagacctctctctctttgagacagggtctcactctgtcttccaggctggagtgcagtagcgcaatcatggcttactgcagccttgacctctcaggctcaggtgatccttctgcctcagcctcctgggtaactgggactacaggcatacaccaccatgcctgggtaacttttttgcttgtttttgtagagacgggatcttgctatgttgcccaggatggtctcaaactcctgggctcaagcaatcgcctgtctcagcctcagaaagccctaggattacaggtgtgagtcactgtgcctagctggatcttattttttaatggctgaatagtactccattgtctacatgtaccacattttctttatccattgtctgttgagggacagtaagtcgcttccaaatcttggctattatgaatagtgctgcaataaatatgggagtgtaggtatctcttcaatatactgatttcctttcttttgggtatttatctagcagtgcgattgctggatcatatgatagctctgtttttagtgttttggggaatctccaaactgctctccaagtggttgcactaatttacattcccaccaaccgtgtatgagggtttcgttttctctacatcctcatcagcatttgttactgtctgtcttttggataaaagccattttaacaggggtgagatgatatctcattgtagcttttatttgcacttttctgacgatcagcaatgttgagcaccttttcatgtacctgtttgccatttgtatgtcttcttttaagaactgtctcttcagatcttttgcccatttaaaaattggattagtagatatttttctatagagttgttcaagctccttatatattctggttattaaccccttgtcagatgaataatttgcaaatattttctctcattctgtgagttatctttttactttgttgattgttttatggtggcttttgatgaacaataactgtgtgattttaatttattaatcttttattttagggttaataatttctaagtttattttttaaattgcagtaaaatgtacatatcataacatttatgattttaaccatttgtaagtggacagttcaatggcactaagtacattcagatgattgtgcaaccatcaccaccatccatctccagaacacttttcatcttcccaaactccatatccactaaacagtaactcccattttcctctccctccgctccaggaaactgccactctactttctgtctctgtgaacttgactactcgaagtacttcataatgaggagaataatacagtatttgtctttttgtgactggcttattctatttaggataatgtctttcaggtttatccgtgttgtagcatgtgtcagaattttcttcctttttaaggcaaataatattccattatatgtacatgccacattttgtttacacatttatttgtcaatgggcagctggattgcttcccattttttggctattgtgaatagtactgtgatgaacatgagtgtacaaatatctctttatgtctctgcttccatttcttttggatatgtgcccagaattgggatatatggctggaccatatggcttagaagtggtgaataacactgcagttagcttgttgcctttctccatctctagatccaatggggaagaagaggagagcctagaacatgagggtgagaaggaataagttctctccattctagggagagcacagctcacagccatggggaaggtgggtagtgagtgttccagaagactttatgtccctactgagcattagctgctggcctcttcagcataggagaaggacactgggctggctccacaatggagctggcagggatcagagtacatgttctggtatatgaggctgccatgcaagagggcaaccccttgtatgggggtggggctagctgaggggaaatcaaagctctttactgagagaggccaggcaggcagccacaggccagcacacacgtgcacatcatctattcatcgtttcatttgcgtcactgattagatggccaccacattatacatgtccgtggggcattacttacatagaatagaaagtgaatagcccctcctggattgtgcataatggcagccatgccaattgtactattctaattcaaatgtaaattgtaacaattatgccccaatacaaatttctgcactataaaagaattgaatcatcttgctgcatattaaggccttcaaacttctcttaggggacagtctggtcattgagaaagtcctgttacaagattatgttttcttggagaggtgttctagtgttctcacattggggaaagacaaaaacaaaagtaaaatatattgcatgctagatcttacatgttagttagttgctaagaagaaaaattaaaaatggattgagaaaaagagtgctgaggtccatgggaggcagggaaagcctccatggaaagacagcacatctgataatatgtagttatccctggctagaggataagagcctgctcttagtcacagctccagtatcagcttgcttttagaaaatgggctgggaggagcaagccgtgtggatctctggggaagagcagttcagataggaggaaatgaggctggggtgagcctggcatgtttgagaagcacagaggtggccagtgtgtctagagtagggtggtaaggaggagaggcatgagaaagcagcggggagagaaagcagggtaggcaggctgaccatgcagggcctcctgaattcccaaagggattgtcattatttacctggagtaagatggagacttctctgaagtgcctgctctattcttaatactagatgctgtaaagtgccatatttgaaaaaactgacaagctcataatctagttggtgcctgttaacagtctgaggaggggcagatcagtccataatccagttgggaacattgagtcagttttacacaggattcagaaggtgaaaagacaataccgaatgggcatttttaaatgaggaaagcagcagaaaaaatcacagaagaaaaatcactgatggcataaaatctttcatcatcttgcaaaagcagttccttagaatgttattgttcctggtgttcatttataacaatgggagccattgaacaacctgagccagtgactgtcttcttttagaaatggaggaaacagtccggcagctcatgatcagcaagtttggccgtgtggtaaatctagaagcccttcaaacgctttctgttaatacaacacttgaagaactgaagatcagaaaacttcgaaaggagctagcaaatgcgaaagagatgaagatgtgggaggtaaggaagagaagggggttgatctttggttgaatctggctggaggcaagaaatcccagggagcaggaagtggtacccatgaagcatctgtgtagctggagctggtccgcgagccccctttggctgccccaggatcttaggccttgtctcggcttctttactgttcacttagttagagggacttgtttatcttggagtgagagcaccagcactaggttttggggtccagggtgcatataaatattatgtaaaatggatgaaagattatggagagatctcattttgaggcctacattaatgtataaatgctctgcagccaaaaattatatttaaaaatgctcagcatcactaatcattggagaaatgcaaattaaaaccacaatgagaaaatgaaatatcatctcacaccagtcgggcaaagaaaatgtgctgtgtatgtgtgtatgtatatatatgtatatagaataccatggattactacgcagccataaaaaatgatatcatgtcctttgcagcaacacgaatggagctggaggccattatcctatatgaaataactcagaaaatcaaatactgcatgttctcacttataagtgggagctaaacaatgggtacatgtggacataaagatgaaaataataaacactggggactccagcagcggggaggatggtgggggtgagggttgaaaaattacctactaggtacaacgtttgctatctggtgatgggtctgctagaaacccaaacctcactattacacagtatatccaagtcacagacttgtacatgtacacctgaacctacatttttttaaaaagtataaatgctctgacagttttagaaatggagtggctatcctctcaggcttgaattgtattactgtatggtttttgcatgctgtgccaatttggaaattatgaaacacctctaagtaataaattttgtaacaaggcatagactgtttggctgatacagtcttagaggatgttaatgcctacatattgttccctgagccatgagatgagccttggcctggttccagcctgattcagagataggagctttcacaaagattttataagtccacaaaatcatgatgacttctccagtttcctgtcttatctcattagcagatggggtaggaggagagcttcctagtgctgtgttgtccaatggctccatctcaacttttctaatccaagatgtaccactgtactttaaagaagcaaatagtgttcatgtcagtgggactggtccctattaagggaatgttggcgataatatatgcaatctaaaataatttgttggaagcctgggcaatgtagtgagaccctgtctctacaaaaaataaaaaattagctgggtgtggtgttgcacaccagtagtcccagctacttgagaggcttaggcagaggatcacttgagcccagaagttagaggttgcagtgagcaaccgatggagcaataagaaaacaaaagaaagccattatacagatgtgtggccactcaagccagctaccttaaggatcctgggccaagactgggaaaagatggggaaaaagcaatacagaaaagttagctgcttaaattatcacccttccttttaagtaatgagtaccagcaatcagtatgcatagtaatttcattcctcaataatacaatgatgtccacatctatcttatttctacctactcctattcttgagcatacttatattcttatctttaatcaaaccagacccaatgcactttgtgttgcattttcatattggcttctgattatattttcatatgggcacattgctccatttgcctgatgattttgaccaaatctggacactcatttttctttctttcttctcgtattcactacatctattttgcatcttcccaccctggtaggaaaagattgctcaaatgcgatgggaactgatgatgaagacaaaagaacacaccagaaagctttatcagatgaatgatttgtgtattgaaaagaagaaacttgattctcggttgaatacactacagaatcagcaggtatgttctttaccttcagaccctttttcggaattgaggaagctctgtcaaaggtagctattcacaagaatgttaagtactggcatttaaacaaaccttgcttgatcttggaccacttccagaccatctgcgtccccgaggacactgagttggtgttagccacattacagtgggcctgagggactagctttattgaacgcctcttgggtgccatgaactcacgtaagtactaatcaatagaattgccttggtcctggagaggtgtaaggttacttaggtatgaataacgacaccattatacgccctgggtttggtgtcaaacatgtatttccaatatctgcaaatttcatttgacttgaagtgggcatcttgagtggtgaaatctaccctgttttcttattaaaatgcttgtcactttgtgtgggtttcaacttgctattacataatatttagccagcctaacattgtacttaatacattgtatgtggtggatatacctaattaatatttacccaatccaagtcttgccctctacaaacctaacacatgtatagcatattccaaactctatgttatatacttaacaatattacctgcaaaaaggccagttgtttctcttggtcttctttgctttatattttctttcagaaccctggaaatggtctaagctaagtgttccaacagtttggtcctctgaagaagagcatcagcatcacctgggaacttgtttaaaatgcaggtgctaaggccccaacccagttgtactgcttcagaagcctgaggggaggggcccagcagtctgcattaaccagccttcccggggattctgaagcacactagagtttaagaatcactggtctaaacaaaagtcccaaagtaagaaacaatgttgtttattccatgaaaagtgaattaggaggattgggaaggcttataattgaagattagatgtgaaaggaagactagaatttgaatattgaggggtctttttccactgaagaacttttgagtgaaggatcaaggcagtgtttgagaaggttaatacctaacccaaatcttcacagactgagtagtcagtcaacatttgttgagtcgatgtgctttgatcagtccagatacattggagaggaaacagcttagaggcaggagatcagctgaatgggagaggaagttactagttatctgtctctttacacagtatatgtttacatgtatggcctcttcacataggatatttcatttaatccccaaaacagtactttctaaagctcagaggagctgagtaacttgctgaagctcttagagctaatgcatggtgaagttagttttgaaattcaggtctgtctgcctccaacgctgactccattgcttcttacaatgatgtaggcaggaattgggatatagttggtgacaacaaaaatgtgtcaaatatcaaaagccatctcaaagtaagaataaccaaaatttgattgagtctggtgaggagaaggggaaagtgaggtgacttcaaagtaacccactggaatgactgggcatgagttggtgtatgaggcatgcttttagctacaagcaaccaaaagccctattgagagtaccttaaacaaataggagtcatttttctcacttgacaagaagtctagagggagatgactacacgctttggttttgtaggaccatgatgccagagcccatatctctgtgattttcctaaagtttccttcaaagtcacatgacagctgcttcagctcccatgtttcacatccatgcaccagcctcttctgtcccttttattaaggagcaaaagtttcagattatatccacttagctctctctagctggaagagaaaatgggtaaggttaagtgtttagctttcatgggctctaaaataaaagtgagcaagggagaagaggcagagggtgttgggtaacccttactatgaaggtctgctatagtacataggagtaatggaaaaagtatggacttttagcatcaggcaacctgtttctaactctgcttccagcttgacttggctagttaatgactccctgagtctcaatgtccttatctgtaaaactggaatgataccacccagttcagagtcattttggggattagatgagagagcatatgcaaagcaccttgcacaaagtgggcaccacgcaagtattatgtctttcctttcacagatgtattcatgcattcaaatgttattgagcatctacttatgtagaaagcactagggcaggtattggcagagtgatgagacttagtcatatggagccctgtttctaaaagacaggatctcgcaggaaagataggtatcaaacaagcactttggtcatgctatattaaattgccattgttttagatttaaaaaatggtcaaatatcataaatattacatggttcagaatgaaccatgtaatattctgtaaattatagtgatgtatatgtataatggatgtttcgataaaacagaaagcaggaaatcctaacctagtccatggggcaaagaaggcctccctgaaagtgatgtgtgaaacatgagtaggagtcagctggacagggaaataactccgatgaggaaacagaagatttcattctgggaacccaaatatgggctgtccagaaaaagaaagacatactctgtcttttattattccagtgatgagctctttaggtaatgaatgactgatagctagcttaaagtgtactcatccaaagaggatttgcacttgaagagttgtttattagcccaaaggcacacatttctaatggtgggattttagcagaggaattgaaggctcccgagattaaggaacagtggctgtttagggtgactgtcaggccagcactcatcacagatacacagtataagggcatggagtttttcacatgccaaatgatgcttcaacagggagctgttttctttcaacagggcaatgccttccagggccctcgggaagcagatgttgtggcaagagaggaggtcactgaattgatccaactccaggcggaaaggatttcggccttaaaggaggagattgctcttttgcgtaggaaaggcagtcttatcctcccacccattcagtctccacgagagaaagagatacagcccgcagacctttga

SEQ ID NO: 33 - DNA, 201891 bp, Homo sapiens
gctcctttgaccccagtggcagtccctgtcactgcaccgctcgctctccctccggctcgccgcgccctcgctccctctcctcgccccctcgctcgctctctccccagatcgaggctgctcgggtcctttctccccccgcctccctctagcgccgcgccccctggcccccagccccagcctgcggcgggacctccggggtcgaaggttctggcccgctcgcgcccctcgccgcccccgcgcgcccccagcgctcctccagccggctcgggccgctcggctatggatcgcctgctcgccgggcgctgaaggcatccccgggatccggagcgcagcccgggaaaggtaatccgccccgggaagggaggcggagggcgggggagggggaggaggcggccgggagcccggtgccgagcactagaggaagggaaaaaaatgcacacacaaagcggagcccgggtgagaggtgccttgtcagaggcgcgtgcgaggggctcggaggctgcggacccgggctgccccggtgcccctgacatccgcacgagcgggcgcctcccgggcaattcggcgctcggggagggctgattttcaacccctgagcgaaagcaaattcttttttaggaggtgtcttccctccgactccccatcctgcgcctcttctcttctccaccccctccagccatcagtcccccgacctctgggggtccccacctcttcgctccctcctccgccaggatttcttaggaggagaggagggggtatcggcgagaagctggggaagccgggcggcggggatgggggtggggacgagggctcagcgagctgtttactagaaagtcccggggtgatgtgttcgagccgccccggcctaggcctgggtgcattgtgttggcccgatccccgggctcccgcggcggcccgaggccaggtgcagtgacgaggggaaggcaccgcgcagctttgtgctccggctgcgccccgcggccgcccccggggccgcccgcgcgcgccgctctcgctcggggctctttctcaccccgtccccgcgccccaacctcactctccgccgctgcctgggtctccgcgctcgcagcctgcggagcgacccggcgacccaagctggggtcgaggctaggcgacgggggacgagtaccgaggaaaagtaaccgttgccgccggatttcttctctacagaggcaggagtttctttgctatttacgtataacaaggttatctttgtaaagcctttgaattccggggttttgcggcctaggaggtgaagggggcatttttctagaggctcaggagccggttggaatccgtcagcaagaaaataaattaaggatgccccagtgaagttgatttataatagtacatcaccacccccctctcacacacacaccccaaattaagtgcaaatgcgggtcatgaaaaatgtataattgatttgagatgctgcaaacaaacacaaacaggtcgggggggtgggacaaacaaaagtttaagtgaaaaaagatgtcagaagagggggagatcccgtggcctccacacccccttccaacgctcgctggctccctcccttcctttctccgccgttccagggaaggaacctggcagcgcccaggcgtagagcagggaggaggcggcggccccgggctcgggctcagcgctgtgggttcggggatgccaacgcgcccgggaggctgaggtcggggacgtggggctgtgatgcccgaccgaggatggcgtggtgtcagagccattggccgccggtggtcatcaatcaatccagagctagggaagagggagagaaaaaagataggcgtccagcggagcccggggccgccagcgctagcgccagcagtgccagcaggagcggcggccgaggaggtgacggaggtggcaacgggggactgagcgagtaaggcgctggtgtttcaggaaggaaggggaagttgtagccgggaagagccagccgtgagcctagaagggcagggcgagtgtatgtggtgtgtgtgtgtgtgtgtgtgtgtgtgtgtgtgtgtagttcataaagcaccccccaccccgcctcgcgcaactgcccaccaccctagatttaaaacaaacaaaccaatccaaagtagagaattccgcgccccccaccgccccaccttatatagactccacgagttgccagaggctccggagaaaagtcttgccctccctctccgaaagaatgtgtcacccgggtgtccgcagtgctggagacaagttcaggtgtaagtgcggtgggagggagggcgctcggtggacagaagcacgtggaactttatgtcagcctcccccaaaaaaaccctggcggagaagcccgccgggaaggcgtgtgggcatcgctcccagatacagggatgagtaactggaagtgggcataaaagagtaggggcgtgaattaagaacgcactggatctgcgcggcagagggaggagagagcgaaatttggcggatttggagcaggcaagttccaaagtcccgccaggctcggtctggagatcttggggcaagtgattaaaatgagcatccttgttgaaacgagaaaaccgcgggctcttttctcataggctgtgctgggcagtgcaggggtagagaggtcatgagttgttgctttgaaagttttggtaaattggacttctggtgtctaggaggtggagacagttatttaattcctcagcttttaatcccttcattgccagccgactttaaaaggttttccaactagattcctggaaaagaatattgctagttgtacagcttaaaggacagaagtgattgctgtctaggaaatgcaaaatgtactcacatgattttctttttaaagagaaaaatcaaactagcaccagcatgaatgtttggcagtgtcagtcccttttagatttttctttcggcttcttgatatttcgtcctgggttcctttgttttgtggaaagtgtgttgaagtataaaatgaaaatttatgaaaagaatagtgctgtctttaaatattgtgtgtaaaaagttaaagtaagtgtgaagagggtgagatgcacgaaaatctgatcatttggaaggttttactgcctaaatatacatcttcttgatagttgtaagcagtgtatccttctgtcttgtttcaagctctctccaaatttctcaggttataggaagtggttttgtctattgtcccttgtctctgagagtttaccaaaaaaaaaaaaaaaaaaaaaaaaaaaaaaagaaaaagtcttttccaggtgtttgtgtttaaaattcttaagatgtgttcattttgagatacgggtggggatgaacatagcattttaaaaaataagccttttcttgacttgtctgtaaaggtgctgtgaaagttttgaagctctctgcctcagtctgacattttcttcaaaggactccagattaaagaagatagacgctgcaggtgcactgtttcgatgaaacatttgaaagggaacatggcaaagatgaattcaaatgaggtgccagccacccatttagcctttcagagttacaggggcctgtgcttgctgatgaaaagatgttctatttgtcttactggggcaaaggtgcaaagaggcatagatgttcagtgatagagaaggttgacattaggatcaagcggaccatgtagaagtgcaaattgatcagctgctaaattctgtctcttcttagcttcaaatagtagaacttgggtgggtatcatgctaactgctacaagtcattacctagatgtttaaatattaggtatgtatattttatttctaggccacatttgcttggtttaattagtgtgtttactccagaaacatttaaaatctttctagtactgggtgcagagattgttactcagaggtcacagcggtctagacatgaatttgatttcctttgcttcttaatgttcagtatttcacacaatagacattgatggaagaatgaacataagaattgtcaagtaatttttacaccactctctaatttatgcaaacactaacttctcacagtctgaaaatgtgaatttttccccctctgtgctttgatggctaacattctttttaatgacagtcatttctataacaggaagatgttttcatttgtatttacttttcagcgcgacgcaattatgcagttttgcgcttcagtagtgtctcggtactttgtgtctcaaaagagaattacagtacttagaacaggactgcaatttgaagcaggtgttgtgttttactgttatgcaaaataacagtaaaatataattgtgggagaaattaaggaaacagctgcaaacttggtatgaaaactgctacattatgatttgtaagcagttcttatagatatcttacatcagaggagcagggaaagattttaatttagttaatcctactggcctggttgtctatcatctggcgcttaaaagactcatacctcccatgaagtcaggaaaaagaaagagaacccaaagtgacactttgtttaaaatgccagagcacggggattcatctcttggcagtgcacttgacattaggaaggcaggcaaggtgggtgttatttagcttgctttgctaatatgaagaaggcaatgatttgagtagaacactctggaatttcttagcccagctagcatatgggggattactcaagccccgggttgtaaaataataaaataaatggcctatggcaggccatctgccttttgctcgatatttaaggtgtttcatgccaattttaaatctcatcttattattctaaatatttttatttgaaatagcagataagattctcagagcttaatggtgcacatggcaaacctattctgacgttgtgcacttaaagtaagagcatgggttacctaagggttacccaaggagtgtactacggcttcttctctaccgcactgatcaattgcaacaacttggacatgagaatttgcttccctcagcctttgcacacctaccataaaaatagacatcttcatttctcaacccagtgcagcaaataatatattgacatttatgaaaaaatcagaactaatggaaattttaaaaaatgaaaccaattactgagaattacgttgcaccaagaatgaggtggcagatgtaatggccgcccttctttaccgctccatcggggcttgaagaagggaggtaatgaatgcattcaaagtggtggtccagacctggaggtgtttggttttcccctgagtgactggagtgttgaaaaaaatgacactacatttaacaagaaagatttgccttaccataaggttctgggccagtgaggaatgccaagcattgcctacctgtgtattttgggagctgcttgtgaaagaaaaaaatatgtgtaatgtgtggttattatgtgcatgttatagtaatacacatgtatttgttataagcacaacattttaaattcttatctgtcattgtgttatatagctgctttaaacatggagctttcaaatgattacgtgacaccaactttgtaaagaccaaacattccaattagcagggcaggtttggaagattcttcacttggagcacaaaccatgtatagccagatgccatggcaacggtggatatgccccttccgtaattcacgctaagtgccataattataattaaagaggaaatcttagtttgaactccattgagaagatttgctagcacccagcaatatgtatagagtgtaatatccactttgaagtgcatgaagggaagagagttgggaacagttgtatccatgagccaacaacacatattcagattttccctgaactagtttcatgtctagatgttaaatttatgtctcttagaacaccctttttctctttgttctcattttatatacattttttttttctttcagaaatgcacagcggtattgatgagtagatccttggattcagaggttggctgaaacgcaccatgcctgcttccatcttttgctctgtaaagttgtgaattgctcatgcctatagggaggaaggatggcacatgggattccttctcaaggcaaagttaccataacggtggatgagtacagctcaaaccccacccaggcattcacgcactacaacatcaaccagagcagattccagcctccacatgtacatatgtaagtatcgcttatgaacttaacaaaattagcaatcaagaaaataaaaagaaaaaaaagaaaagcattcactattaacttctgctagggagactaaaaggtaaatgatttacaaatcagatggatatctgtggtttcaaatacagctcaggaggaatcccatacatctgtgtaacatttcaaattttcagagcactttcaaccacaattgaaattagattttcagagcctctgaggactggtggttggttgcccctatttatagataagaacggaaaagaacagagaggttaaagtatttgccacacagcgaatttgcctgagactcctgacccctagttcaatttgctttacattgtattgcttgcctccattctgaaatatttctttaaaatttctgtagttttttttttttttcccacacctcaccccactagccctttacattcagctgggaaataggcctaattgggactaattgtccagctactgctagatccattgtcttgcctgttgctagtgaaacgtgtgctgcatgctacaggactcaaacaatatggggaacaaaggaataagggacagtggaacagttggttccaggaattgtactttcctctcactccctaatactatttaagtcatgttgaggtttaaactgtttaaggagcaaagtgtggcagaaacccagaggcaaggattttgcagcacctggttgcacatcaacttttttctggtcctctgctacaggatgtgctgggctttcagaagaagggagcaaaaggtcaccatctctcttgtttattcaaggcctggtgctcattctctatgagacccttccaatgtctaacatgagtctttcatagtaggactaaacctctttgaaaactattgtatagtcaagatagaaaggaggttagagctctgttgactgtttttaccactcctggaagaattgaactcggggcatgtccaagtcacaagctctttttttaggaattgttttacatgagcatttaaaaaaaaatagtaggacaccccaaatacacacacccccccaccctggaatttacaaacgctaaccaaacaaaagggtctttccattgactgcctggatattagtgtaaatactaggatgttgctttgcaagtatattctggagagcgagtcagttacctatgatgagatttctgcaaagcagccgttttaaagcagcatgcttgagtgaccaaaaaaaaaaaaaaaaggaaaagacaatccttgtaagtggttactgctaaactatttgaaagaactttatacgttctttaaatgagaatatattcatgattatgaaggatcgctaacatgattttaaggaaaaatggataaagtttttctttgttaaaatagcttttctgaacaataaatatctgtttaattcaaatattctttttattctactgtttctatttacttgtttttcttcaaatatgttacaatatttgtgtaagccatactttagaatagcttcagttctgttttgctggtgttatgtttttgtattaaagaactacaaggaactttgtagatgctgtttccattcaagcaaaacaaagtgtgttttgcccagattccttggaaaatgactgctggggaacctcagcttagttctcaagtctgcagacatctgctcacttgttcttggcctcaagattccactggcgaactgtgaatgcacagagatattttaaaaatcatgtaactttaaagttgatctgcttttatctagccataacaaatttgaaggatcaaattatacctcttttgaaaaaaatggcttgaaaatggggcaacctagacagctgtgtagtgctttcaccagactcctgatcttggaatagaggattcttctacaggctagttccagtgtaccttttcacttttattgccaataagggcttcccatctgaaccctctgcttcagccacacagtttggctccctgtcatctgaacacatcttagcaccttccatcttggtgccattgccatcactgtttcttacagagcgtaacacatttacgctctgctcatcaaatgcctcaaagctagtttaggttcctccacttaagccttttctacctatccgtttccaatccaaaatgatcatgcctgcccaagttacttggcaacactttataccacctccattattatttttcttaatctgtctgtttctctgtctacctacctacctatctacctatctgtatctatctatctgcctatctgtctcttattcttttaattttttacttcttaaagaaaggcttgttcttctgagcaggtgacagatgctcaaaaacactggtcaattgatccattgatttgattatgcattgaatagagagaatagattgatgcttggagattttcactggaatttttctgtcagttcttgacattttgaatgttttcatgatggtacgtgttgtcaggaggctggcttaccttttccctggctttactctttcttgcttgagaacatgccattgttttgtaggcctgatggcctcacacagtgactgacctatggtaggtggtcagggatcttggttggatttaatcatgtcatatttctgttatgttaagaaacaaaaattggccttaatctaattagaaactttaattggctagaaaatatctataaaatatttagtctaaaatgtcttcagtttttctgaaaatttcaacatgtcatggcagaactttgctcctctccccgaggtaaagatattttgtcttttccacttgcgtagttgctcatttattttgcatgggattgttaaattatttgcttccttttttcacttacacttgagatttctgaagacccctgacagatcacttggattatagttaaaaaccctatccctttaatgatgtcttactttcttttctacagccttgtgatggtagttggggtttttcaccttaattaggaagagctcacttcccatttaattcaattagtctcagctcagctttgtgactaacaaattttcttttccaagtctcagtttactcatctgtaaatatttgcaccaaatgatggttaaggatctttttagctctgacttgctaagattaagattgcagttaagacaatgtttatttgcaaggcgatgctattaaggaaacaaaaataaataagacccagtccccatcttcatgaagctcattgctgatttcagagctgatgtttcaaacagctttaagaagcattggtttagttttcatctctgagttctgacaagattaccaccaagctctctaagaatgactggcttgaatctctgcttgttatggagggaagttttttttttttagaaagcaatcctgtatgaccttgggaaagaaaattaaagcacagctggagttggcagagcaaaatttaacctagaatttgtgtgcctcacttacccagactcttgagcatactaatagatgtgatgattgaagcccagcaattaacagggtttcatttttccacaaccccttcatctttcccaagcagaatgataagaaaaattatttagtatttttaatgatggtgggaggaggtgctgaaggagccaatgtaggtctgaaaacaccataaagattttgtatgtgtttcataatctgaggcctaatcaaatgttacaaaactttattagtagggtatccagccatttcagttttagcattgaaatccccgtgttattggaatgccataggacaataggataccctactcaggttaattcttcatgtttttctttaaggattgacgactagggaactcaaatcaagccttgttttcagttttagccactttccttatctgcgccttctgttgttaacaccccttgaatcttacactgcacttgttcttttaccctggttctgtggaggcaggttagcatagtggtcaatatcacctgtggaatcagattaccgggtttaacatttgcttgcaccactgactagctgtataaccaactgtgaatacatactctaacttccttatgttttatttttctatctgtaagatccggaccataaaagtaatgcctatctcaaaaggctgtggaggatagaaggatgaaacagtattacatgttaatgcttatacatacatagtctatgctcaataaatgttagctgttatcattaataattttttcattgattctgggtttttaattttaaactgccaattcatttgaaaagcagtggagtgtatacaaatgaataaataaagtcattgctaaatcttgtcctttcttcctcatggagctatgagcagcaaagagtcatggaaacttttctaggtgggattttggtttgtcagggttggcaagtgtcccggtttagtgcctttcaagattataaacagcctaggagtgtctcatccacctccagttactccacgggagtggcagtcccaaggcggggatggaatcttgtgagctgagtgctgactggttgctgtctgtggaatcacagtggccttcctccacatgagctggacctaggttctctgtaccccagtcagtttcttagacttcctatctctatctgtggttaaaacaaaaacatcaagcgctatctgtaattaaccaggattgagtgcaaaaggcacagcttgggctggggaatgaggacaatatacacatggtagctgagaatatggtctgaaatcagcgatctgtatacaaatactgatcctgccagttactggcgtggctgggtgatgatggaaaaattgttgaacctgtcttctcatctgtaaaataggtttaatgaccctttaatatggttgtgagcattaaatgaaatgatatataatgacatatagtgcccaaaagataccacttgataaatagattttatgataatatatatggtattgtctaccagctgatgagtatgagataagttgttaacattttcctttctaaactacttggctatatgaaacctgacaagtccaacttgttttattttgtattgtgtagtatctgtcagtgttgcttggccatcgctagttaaaaaaaaaatctgtagcttttagggtatctgggtgattatttcatgccaaagtactacaagattttgtttgtctgatctgagatttcattcttattcagttcaagaatgtggtaggaagtaaatgtttgttttagttctgtattagatatgcttacgtataaaaacaatgttacagaagagtgttatagaaaaggtgtcatttggctaaataactatataaaagtgtatggaaggataaataacattactggtgatttttagggaatacatttggaactgaatttgcaggagggagtgttggataaggaccttttactttttatttcttatactttcatataatttgaattattcttacaacaagtatgtaacacttttatgattaaaacttttttaaattgataaaaaatgtaatttgtctccaagtccttatgcctggcctgtaatatttgctttaaagtcttgatctgatgcaaatcttctattttcttttgtactcactttcttgggtagcaccttcttctattttatattgcaatcaaggaataggccaaaggctgttcattggttcagtataactcaacttgctcaagtgtgggaagatgagaacagtgttgcctacttcgtcgtcttataactgattggaaatttttaaagaagtatggtgtcacttaatgacagggatacattctgagaaatgcatcttctaggcgatttcgtctttgtgcaaacatcatagagtatatttacacaaacgtagatggtataacctaccatacacctaggctatatggtatagcctattgctcctagtctacaaacctatatagcatcctactgtactgaatactgtaggccattgtaacacaataataactattgtgtatctaaatatatctaaacacagaaaaggtataagaaaggtagagtataaaaaattaaaaatggtccacctctataggcacttacatgaatggggcatataggactggaagttgctctgagtgagtcagtgagtcagcggtgagtaaatgtgaaggcctaggacattactaaacactactgtaggctttataaacagtctacactaaatttataaacaatatttttgtttcttcaacaataaagtaagaaacagcttactgtagcttttttactttatacgctttttaattttttaaaacttgttgactcttttataagccagattaaaacacaaatacattgtacagctgtacaaaaatgttttctttctttatattcttattctataagctgcttttgtaccaaacttttttatttttatttttttgctttttaagctttttgttaaaaattaagacatggtgggaagggaatgaaggatttaaactacatgttggatacattgtacactactcaggtgatgggtgcactaaaatctcagatttcatcactataacaatttatccatgtaaccaaaaaccacgtatatcccaaaagctattgaaataaaaaatgtgtgtgtgtgtataaaactaagacatgaacacacattagcctaggcctacatagggtcaggatcattcatattactgccttccacctgcacatcttgtcccactggaaggtcttcaggagcagtaacaggcatggagctgttatctcctgtgatgacaatgccttcttctggaatacctcctgaaggacctgcctgaggcagccagggttttagttaactttgtttttgtttttttaataagtagaaggagtacactctaaaataacaactaaagtataatacagcaaataagcaaaccagtgatagagtcatttatttcattgtcaaatatgatgtactatccataattggatgtgctatactttataccactggcagggcaggtttgtttacaccagtatcaccataaacacatgagtaataagttacaccacaatgacattatgacagctaatgtcattaggcgatagaaaattttcaactccattgtaatcttatggtaccaccttcatatatgtggtctgtcattgaccaaaatgtcattatgcagctcatgactgtattttcaaatccatttggggaagctaaaagagtatacagtaatagacttcttgatagcgtttcagggaatctgcattctagtcctgtcgtgatcactaatcagctctgatatttagcaagtagggcctctctgaatttcaggttccttaccagccaatagacgtaatggtcttagcatcatctcttccccttttaacagtctgggatttctcctattccttacctttacatttgtccatgtaaaattaagaacacaaatcccacatcattagtcatattctttagggaaagaatataatagagacatcattgggatatggtggtgagagaagagaaatgacccctaacgctcacacagaggaaaagtcatatcagtggatgaatgaatgaatgtctgggactctgtaaaatggcacttactaacaaggtagaaatttattttgttacagagttgggctgcatttgctgttttaaaaaaattctaaacatacacttctttcttggtaagccactttcttattttcattacagattcatcactgtcctgcacattagcatggccataatttgtaaaatgttctcaatctgaaattcatcatagaaatgctgaattgtccttttagtttgcactttatatataaacactggatatttttattttcttctctcatttattcttaaaaatacgttctttttcctatacactccctgagggcacctgtcttgtggtccgtgacagttggacttcattttagagctgactttttccctattctgtacatttctttgtttgcactcaagcattaaagaagcaatctaaaattagatttgctttttgtccataggaatttgttcctagaaccctagctgtatgttgcataattggacagtggtttttgtttatttgtttgttggctacttgactttctgggagggtaaagaattttgatgaaataaaacaaatcctatcttctatgttatacctggattttgggtttggaaagttacctacatttgtagggataaagaacgactcatagagaaagcatagtcatcgtcaactcatagacatatcctgcaactaggagccatcagatcacctctccttacagactgaatctatctatctcctgctctaaatacaatttttgttttctaaacttctttcatggggatattttggtaaaaattattcaagtggcaagacaagccaaacaggctgtaatgaaataggtagtttgtgtttgcaacatactcgattttaattctaagctttcaaagcttatgaagatgagattttaagatgtagaaacaaagctaatgctgctaaatctactgcatcctgcacagcaaactctagattattctgaactgtttccaaaaaggagaagcttactgagtcttggaagatctattcatcagtttgtttttcttctttttcagtattgccttagctctttccttcccatgtctttttcccttttagactttcatagcttactggaaactagatgtttaagtagctatcctagcatggttagactattatttcaatatcagtatggacaaaactgctgcaattttgcagaccaccatcttggtcttctttttttttctttttttgttatttaatgtaaaaggtacacttagaagctttgtctgtgtggaaacactaactctgcaaagaggaaactctgttgaatttattggctcctgcattatttgggtctacatatttttattctatttttctttgaagattggttttattcaatttctgtccctgtagaagggacaaaatatatgcaaataagaaaatgcatttttgcagatttttttatttttttcttctttaccacaaatcaagaatataagcttctctagttgatttacatttttgtgcaagtttttattaagcctcagagctgttgaaactagtttaaaaaaaaaaaaagaaaaagaaagctaacatcaccatggaatatagggaacagataactttttcacatttgatagtattgagctttaaaatcctaagtgagaattagaccattaccgaagttcctctgttggtagtggcttccttaaaaaactgcaggactctacatcaaaacatggactctactgaaactcacttatttctttgtacagactgtctctgaaaccttccagctcaaagatttgataattcttggattggaaaaatatcctttcctgtcttgctgtgggcttttttggcatttatactgattggctaagaaaagtggcttacttgtggtatttggctttaggtatttgggccaaggaccaagtttcaaaccttgtacatatttgtacacttagtttaaaatatgttttgaacaaagactttaaactgaaatcaagaaaaaaattaagtctcccaccagctaagcaagctcagcctgtttccctaatttactgaaagagttagccttcttctatgacataggcattttactagctcgtttaagtcctgagttttgggaaatttttctccagtttgttttattttgctttgcctggagacttcaaagataaccaccgaagcctatcaaactgtattcgattttttaatcataaaatcttaactattgctcttagcaccttttatttaatacattctatgtttaagaatgatacgacttttatgtactggttctgcttggatagtgctatggtttgaatatttgtacccctccagaatgcatatgttgaaatcctaactcccaaggtggtggtattaggaggtggggactttcagaggtgattttctcatgaggatggaacccttataaaagaggccccagagtaaccccttgttcttctttcatatgaggttacggtgaaaagatgcctgcctgtgacctgggaattgggccatcagcagacactgaatctgccttgatcatggactttccaatctccagaattgtgagagataaatgcatgtcttttatgagctacccagtctacgctattttgttaatagcatctcaaacagcccaaggcaggtaggcagggaatataatgggaagatgaattttatagagggaacaagaggagaaatgggcgtatttgtgaaggagagagggaaaaagtaggagggaatatatagcagatgtgtttgtgagatcataactcttccttgtcagttacgatgtcctgaccttgggcttgactttagcaccgggagcaggtcagcatccctagacttcagtcaacagggagatgagacaaaattgcaacttggctttctagggtacacgtgccgactcaatataccaatgaatctagcatatgaaaggatcaggatagcaacttttgatactttgacctatgttgatctctgagaaggaatgatttttgggataattcaaaacttttaggcttgtatttcaatattttttaaaaaatcatttgacaaatagtgaactctgaactgactttcgagagatgtaagactatctgaagttgtgatttcccaaggttcgccatctgttagtatctgggagacttaccatatgttgtgctcaaattctgacttttacaggttaacttgttttcactttattcttcacccatacattttgggtacagccggtagcattgaaacctttcttgactcaataaacttagagagaagaatggtgaggaaagaacaaacaggctaggaggtgttgactcctaaaggatattaattcttaattcttccataatgcaattcaaaaagtctaatgctttcttcatgtaaaatacatgtaaaggcttgggtatcctgtttggtacagtggtgtgagtcctgttctaacccctcttgcaactgatcctcctgagaattcggaagggaaataataatcccgtgggagtctgtttgctccacgttgtgcccctcggtggtggtggatggctcccctgttttgcatctctccatctcgaccccaccacgatgttaatggctgtcggcacgctccactgtttatcttggaatttgatcccatcatcttggcaaccaaactgggacctttactgctcagattgtttgtcatttgttgttaattatctgttactataaattttgcactttgagaaaaaagggaatgttttgaaatatttcctccaacatgtaagtggagcttcattttctgtggacaaaagagaacaaaaaaaaatgagcccttttgggagctggttttagggaaatcaagtgccctggtttttcagatgggctcagtgagatcccactagtgcagccaggatttgcactgaaagaacctttgcaattcagcagtggtctaagacagaccattagtgacaggtaccccccattggagggaaaaaataatttaactttaaataaggggttttgctttttatcccaatctctttatgccataattgcgttttttgtatgctagggcctgttcccttcagccactttttaaagattattaatacaaagcagtccagagtgagaagtagcttctgcctgcctgtctttatgaggggtttattttgtcaagtgtagaattaaaatgagctgtctagtcattagtggattttagttctggtctcacactctgcaggaagggtcgtgccatgttataaacagatagcactgttttgcagggtgctgtaccacaggctgcaggaaccatggttgagcttaacatcttcataaaacggtaaacaaaagaacatgaaagagagagagagggaaagaatgaaggtttgtattttagagggagcatttgagaatagagtgactgttgctaagcagaaatctgggcaccattaacatatttaaaaatgaagtcatttgagaagttccaaaaagaaaaaaaaagtatacccagaactactactagtgtcttatctttatagcagggatcataatcatatatgcttcaaaaagtaatggtgagggttatagaagataatgcttagtgcccagtaaagcacttagtgcagtatctaaatgttccatgtatggtggctattattgttaataatattgtgtgtctttattgcctctaaaacattaacatgagcttctgcagttttaatagtgatatgtagtccatcatcactataagttttttcgtgcctttaagtttggtgtgtctgttttattcttgtgaagaagtttttagggttttgctctctcccaagggagacacagggagggaaggattgagtctctgttaacctggtagccaggggcagagacttaataaacacttagctccttgcctgctgcctgagacagtgtaactctcagtgatgtgtcttttactggagttgtggaatttgcttgggtgaaaatgttctcaagtttataggggttcatgataatagtgttggccctgaaataaagcaccatttctaaatattccactttcactatccttgtatgtcttctttctcagtgtttttcaaagagaacaggataagtgcttgggcactactttagaacacagattataatcagactttgggattaagacgtgtagccaatgtattaaattagtcacttagtaactgtttgagtatgagaataagaaactggagggaggagattgggagctggaaaaaaagcaccccctgattgctctcggggaggctgggaaaaaggatttaacactttggattttttaggagacattaaaactctgatgggatcaaattacttgactgcacatctgaaacatgaaactcttgccctaaaccgtgcaattgagttaagctcaaaattctaggcctgcccctaagactggcctctgggtaagcctcattgttgatcgcaaaatgatttcctttgagaggaacaagactacagtgaggtttttatggccaatttggtctgtgcattggtgccagccagacttttggcaagagttagtgccaactttggtgatctgtccaccgaatttttcccaaggtcttcaaaaccgtctggatttactgctgacattgaaggaaagatgcattataagtccagctttctaggcacacctcctgtattttttgttttttcaagtagagagatactgagaggtgccagagaacaacaggctgatccgtggccgtaaactttgagtcacaaaagaatgttgacagtcttcttcactaaacactattttctctctctagctttgtcccctttttagggagcccctgtccttctctctggattaggtgtccccttatacatactcccagaacctgtgagtgatactgtcctttggctgcacttatcttaaatatattcttgaattgttggtgaaatgtgtgtcttccactaggatataagctctatgagggcagtgaccttatctttttcgttttatttattttttgctgtctgtattcacaacacctatcacaatgctaggcatgttctggagactctgtcaacacctgttgaatgaatgaatgaatgaaagctgagtttgcaaggattcgaggaattaacatgtgcttccccaggaagtgagtgctgccttgtaatcactcattcattttgagagcatgtatgtagacttgagggtgtacttggctttaaaaagggtaacttatgtaagtctcccgtgtttttttcaggatggagctggatgaagctcagagtgagtatttctgatactcgtacactaatgctatcatctctgccttcagttgacttttgctttgacagtagtaaactctcatttctaacataggaaaaaatatcaaagcttccactttcaatgtgaccctagagatttgggttttctatattgttctttaattttaaaatggaggcatcggaaagtatattgttttaactccttataaagtgctcacttattgatcatatttggagtcaacaattatcggtcagaagcattaaattaattaagatatatttcagcccacttacctggaacgtgacaactgctcctaatatgtggagtttacttgaaatgaagaccatgaaaacgggtcatctgtcatcatgggaatcatgcgttttgaataaggcgaaccagtttttattctgtactctgatgtttaacaactctacattttttttttaatagtaaactcttaaaatttttacagaacaacttttttgacaaaaatctgtgatttgggttaaatacagataacaccgtcataacagtattggtatggcagtggttgaaaaccattcttaaaaacattgacttaaaggtaaaacaaaggaaattcaaagtaagtatgcaatggagttctaattgtgggtgactaaactgtcaacaccttgaaaagcaaatgatcaggaaaagatcctgctgtaaactgccaggcttaagaaaattttacatggcacagaaattaaaagaggggagatactaagaaagagaagtctgtatcacaagcacttttggggcaggaagtttttaatttagatgactgacttcaggttttctctctaactttccctgtggctgtgtctactaaggaaggtgttgtataattagactttctggagatgacctttggctgaagacctaattgagtctctggacttgagtgcagggttggagctggaggagctttttgccctgtaggtaaaggggctctgatggacctacgtctttgataagtacctgtagggctggcagtgacattgtttaggtaaattatggtttagtaattgaggagtcagtgctccttagtatatgaaaatctttctttaaaatagggaagacaccaaaatccacatgcgcaatttaaatgagcctgtattctgcattataaatatgcaccggatgccaagtagaaaaccggaacactctctcaggatgctgttagggccaagcggaatctcattagggacagcttcaaagatcagttcctcgcgtccataaaaacaagtgtaaattatctggtgcgcgcctgctgttagcagttgcggtgttgcattatgcatgattcaagactgcacaggggagacacaggctgcacggagttccacaatatatgtggggatttctctacccatttttttctttttggtgctgagtcctacattttggaaatttattggtgtgtttcagttaatggaggatgtcatatataactcactcttacatttttgatgaattggagtcagttcagagaggaatgataaggttctgaattgtttacatgaacagccacgctactcagatttatgtatcttgtttgctcacacatggagtcagattggggggcatgaatgcattccatgcacatagaattgagtgcatttgtttcaaggactctctccctcattttggtctcttggttagattttttaaaataagtgtgaatgctcagtaaattaagaacatgtagtcgagtttaacatataaggcttcaataaatagttttgtaataaatgcctaagggtctgaaaatatatttctgagcttcattgcctgaggagacagggaagcaatatagtgtttaagaacgtggtttccagaagcatactgccaaagtttgaatcttggtctccctcttactctctgtgcaactttgagtgagttacttgacttctctgtgttcttatccataaatgtgacctctctgtgttctcatccataaatgagggaagcaaatagtacttttctcaaagggccattgcaaaggttaaatcaactgctttaagtatagtacctaccaaattttctggggacgtagtaagttctatagaagtgtttcatttggtgttatcgtcatgatcagaggtagaagaccttccagtgcagctgggcatgactaggtatagaacacccagagcctgaatttataagcctatgtttgcttgaatggatagatatacatgaaagctgagggcagacaaagtcagggaatgattaccttggggtcaattagaagaagccactaaaaatacaaaatgcttagtagatgtgtatcttgccagcccaggtgactcacagagataaacatgagatcttgagaaaaggttaagacatagtagcaagagggagttagctttcctctagccagagtagaagaaagagtttgtcaatttccttttcccagttgtttctcaaggcctgttcccagaacaaagaagcatgtgggagaaagatcaaaagatcagccttacacagtgtctcatgacttaaatccatcaatttcccagcacaagttacctccattttgacatgtacattcgctcctataaggggatacccacacatagcaatattgccctttctagactggaagccctataagggcaggattgatgctggctgatcttgaatcctctgccttgtccatgattcagtaacaaattcatctttgacaaatcaataaacagtcttcaatatgtatttctcctgtcattttgtcctcacagtaaattctctctgaactcagaatctccccaccctctttagagttgcctctgctactaacatgcttacctaagcactagttaatggcctatcatgcttgcttcagtgtccctccttacagtttgctgaaattgcccctactatctcctgtcacttacttatcaataccttaagaatggtttgttgggagctctcattttttggcactaagtgattgaggctaccttgggtattctgtagaggtgagctgcgccagcattactgcctgacttccacctcctgtcagatcagctgcgacattagattctgataggagcccaaaccctattgtaaactgtgcatacgagggatctacgttgcttactccttatgagaatctaatgcctgatgatctgaggtggaccagtttcatcttgaaacgtaccccctcatacccccatctgtggaaaaactgtctttcaccacacctgtccctggtgccaaaagggctggggactgctgatctataggacagggagggaggaaatgagcaaggagagtgggatgtctgggggaagctgggtgtcattgaaaatgttacagtaaatcaataagtatttattagaagtagcatgggatgcagggatcctggttgttttgcttctcgttttatccccaatgcatagtacagtgcctgatgcataaataattattgatgaacaaattaatgaaggaatgttttatttggtttagcagtcaggataatatagaaccataaacccccaatccttgtctgctagcgtgtcttgcctgtttacagagacaatcaaatgcatctgaaataaataatatttaataaaataatcatgtgtgcattattggtaatagaatatcaaggttcttaaagtacttttgtgctgtactcactgtgaaggaaacagaagtagagaattttacgtatggcctactggcagcccagagaggttgagtgatgtgctcaaggtcaagcagaactgctggtttctagtacagaatgtgactctttatgacccttaataagctgtaggtgcctaaggaacttacagtttggggcacaataaatgctaactgagtaggagaagcaaggaagaattcaagaacatgtctaaaataagattttttgggcgtctgccttagttctactgaaatgctttacaatgttatttcctagtttttccctgtaggcatgcatcaggtttgattcttctcccaaacgtgaaagaaggtaggcttcccgtaggaggcagcctgtgatggaaagcagtttaaaataaacaggagcagctattttctgccctggaagatcacacattactttcatttcagaatatgtcctcctgtttctaccactcttttgtcctttggttcttctcaagtctggcagcatcttctggccttatgggctccagaaaccactgccatttcctattcagagcctgtgcacacttggacagcaattgcatttttgcttggttgtgggagttgagaagtatgtggccatatgctgtggcttggataatggcttacatttcaaacaagttaggtggtttctggcccactgcttgctgtgtgtggaaatgagcaaacctatatgcttctaggtcttttccatttggagacatgaagatgaaaggtgggatgcttcaacccagtacattttacaaagctcagtttgagtgtggttttcagatctgactatggtcgagtatcaaagatcaagggtaacttcaaaggcaccaccatttttgagaagttcacagaggttactgtttgtaaatgatgtctctgaccaaaaggaagtggtgttactgcacagaaaattgcttctgttctctatcattggtgttggcatcacttggtaggctactgaagtgcatcttcttctttagggttgagaaaccctgtggtcacaggttgctccacaaggagcacttttagccacaggcaattttccttttggaaaatgtggggtggcaggtgtaaggtatcacattaaacttctttatgttggactgcagctgggcccaagttggctttgataataaccctctttgcctaggttgctacgatctagctatcagtaaggctgcagccagactcctaggatgttggcacagtggctggtggctgggcattggtttatttgccagcattgagccagtattacctgttagacctttaaaaactgagcatctcaggacatactagaattcttccagctctgttgcttttctgggaagttcagagatggcatttggcagtacattcacatttagttgagactgttgaacttcacattaagttgaactattgaacttcataatgaggaaattatctaataaaagctctagtttttggtgatgattaaaaacagtggctctggaatgctcaagaccccaacttagtaggcagagaagttcataaaatacacattgtgcagagtccaactagtgaatatactggctgtagcagtatttatttcactgtagaaattatatatctatgcagtccatattgaaataagtgtgtgtgtgtgtatatgcacacccacatgaaggtttaaaattaaacatagatgaaaatgcttgcagaacactccttttggctatttaaaaaacaaataaaacattggacatgtttgcatgtgggttgaacacctcagctaacgattactcacacagttgaccttgttttctattcagggcaccaagaagccacgttgttaagcatattgggtcaacccagggttcacgttaacatcatttttctttctgtggagatgtaaaggtcttcagcctgattgttttctttttcttccacaccaggtggggggtagcatgatttttgcatgactatgggcctgctctataaataagcagattcagtcctttgttttaaatgtaatcagcaagattgcatttgcatcgcctgtaagtgaatcacataagtgaaattacattgcctgcatctcatttggtatcataaaatgttatgggatgcaggctgtttttctccaagtaaagtgtcttgagttagtattagggtgcttgctttcattttcctttgtgaccaaatttgtggcattctacggagctagggcttgtattttcacttatgttagttgctagagaaatacttgttcatgtcctctagaataagctaagatattggttcagtagggggtaaatgggagttttaagactatctcatgccgtgtagcaagtgattgctaatcactttctgtcgtttgtgacaacttctgcttactaagagtaaatgccagtcagtgttggttggaaatataaagcaatctgaagcttttcaggcagttggccacagaaaatggttaacatattttttttttttaaaaaaaaaacttgttagtcatcttttaagcaactactatgaaatacatatcttaattgaccctttaagaggtatccttaagacagaggactcagaagtcattgtaagattctcccacttattttcttgaaaacaaataaacacaataaaaataattactgacttcaaaagtcagtaattttggtgacaaatgagaatgctgtatttcatacaacacctcccctctcccctgaggttttcttaattcgtgaatgctggtggaagtcaaagcaaaggtatgagttcttagataacctataacacagtgtggttacccacaaaacatctgtttattagctacattattgataaaactccacaaggcaacaggcagctatagtgcccattatgccctttggcataatgtgaagactattttcaaaatagggcataatgtgaagactattttcaaaaaggaaatacatgtgaagactattttcaaaaagaaaaggcatgccagtcataatgatataccaacacagtgtaggtgcttgatacaaaatgccctttggttatttggagaggtattaaatttagtatgcctcacatggaataaaaataatttatttttgaaattatatttaaaaactaaaattaaaaaaataactttcaaacatagcttataattttttctataagactttgaaggagatacgcaattttgtgttcccatattatttaaaagaatgtatctaggaaaaacatttcattcggaaggagaagattgagtatagtttctttttaattagtaagcttttaattgacacatcatgcaagttaaaatgtatacaaattaagcatgttcatgcaataaatttccacaaagcaaaatactcatgtgatcacaattaactatggttttaaagatcatttttttgttttagtttgcaaaataatattatgaagtcataagaatttaaatatgattgcaatttacaatacatttttattaataaaagttgtaaagacctttgttactattgctctgtggtttacaaagaagataattgtgaacactgggatcccgttgggttcctatagattcccctgcagctgggtgttttagggcatagaattacatatgtgactattgtgacttttatttcaactggactctaaggaatacttttcattagtagtcatttaagatttcctggaagctcttctctgtgatttgaaaaattctctggataatatttccaaattgatgaccttctggagttaaaacaactttttctttggtctagctttaaagatatctttattttctattccattcatcaccattttttcattgaaaaaattaaccatgcttatcccacttcaaatgagcagctgcactttgaaactagatccttcttttggctgtaattgtccaaatgaggaggaccaggtttgtggactatttgaaaagaattggttgtgactcaaagcatttttctgctttcaatttttctcttcaaattttagtgtattcccaagccagaaaaaaaaaaagaaagaaagaaggaaagagggagggagaaaaggaagaaggaagaaaagaaggaagggctgggcaaggtggctcctgcctgtaatcccagcactttgggaggccaacgcagggttattacttgaggccagcagtttgagactaccctgggcaacatagcaagaccctgtctctatcaaaaattaaaaaaaaaaaaaaagctgagtgtggtggcacatacttgtatttctagctacttgagaggctgaggtgggaggattgcttgagtctggcaggccagagctgcagtgagctgtgatcagtccactgcactgcagcctggtggcagagcaagatcttgtctcaaaaaataaaaaataaaaaaaaaaagaaggaagcaaaagaaagagaaagaaaaaggggaaaaaagtttacaaagtacatataagtaaggcagttcttacctgggaatagctgaactatagcttttgaggaaagagaaagatataggatgatcccagaatttcagcatgagaacgactattgggtttgaagtgtgactataaaccactcagccagacttttctttctttttaataaatttaccagaataggtaaaataataataataaaatacatacaaaatatatacgtgtgtgtgtgtatatgtgtgtgtgcatgttctattggttgaccaattcctgcaataccaatatcactgaaaacaattgtgaaaccactttttgaggattgtccttggagccaggtcatgggcacataaagaaagagttcttcatattttccagccacagacattatctttactcgtatttatttatatcttcctagcaaggcccttaggttccagttcaacacgcccaaggaataaaattcattagtgagttctcacatttgactttctccctctgaccatgaggctcttcttaccaggctaatgtttctttgattggatccctcatggtcattgccatgaagagttctcacatacatattactatagcaacttttcacttatcttcaaatatgttggactgactgtcagaatgttgacccagcagttgatccagatcattctatataaatgggaatatgggagacggaaataattgcacattccattgttaacagcaccaaggtagctggttagagatgtttattgattggttatttagccagtagcctttccttaaaagaaaacaaaaggaaactaacaatcataatggatggacatgtgctaaatctcataactagaaagaatatttgtaaataaacatgaattatagctctgtttattatacaatagtgagagctaataatttgccttgacataatagctgctttcgagctatcatgagtcatgaataaatgaaaatacctataaatttccaaagtatatttgaattcttatattttgcattataggaaatgatacattttctccaacaaagcgttttaattgatatctccagttaagatagaaatattctaaaacttactttaaccttataaatgaaatagcaaatacagctgtttcagagttttgatatatatattatatatatataatttgcttatttggcacagtcattcttttattcattcgctcattgaattcctgctatgtgccaggcacacaaacaaactgaatctagcactgtttaacaaaattgaaatgataatctcataaatgcattatgggggaaaatgtttcaatgtaatgcccaatgtatcagtcttgatgcaaaatttgtgatagcctagagtgtaaaactaacccccttatgattttgatttttttttattctgatgatcttttcctcatcttattgccctaacttggttcaacactgcttttggggaatcccttctctttcttcttacattttctggcctatagggtcatatggcttaagttagaacaaggagaccagtcaaaaagagccaaggcagacaaggcaaaatctacagaaatgataataatagtaatgataataaataatatggctaccatttattgaatgcttattgtgtaccaagccaagtgttaattgttgtaatatattatatcataaccctaggaagtgagtggtgttattcccattttgcagataagaaaaccaaggctaaaagaggctgccaagggtgacctgggttttacagcttgtcaatgacacacaactttgcctgaatctataggccatgctaatctgtcaaggaagcagtgacagacttgtggattaaaggtttggatttgactattttattttcttttccaaacaatgttcatgataaaaccatgtggaattgaagtcatgaagaagcatgaggtaaatgcaatccagacccacaaacatatttttgggatagttccactgattgagattctatagagaagcatgacctaggatgacatcttcactcagaaacaaatatggaggaattcattgtttggaggttggggaatggcatggagaagagcatattgggttaagagtcaaatggtgtaggcctccattccttagtctgtaaaatgagactaatactggttagagaagatggtctccaaggatccttacatttcaagcattctaagcttttaggctgaagttacttaaaattctttgtattattagttcccggactttccactgaaaggctacagggattgatgataatgcaggagagagtggcaaatggaaacctcactctcgtaagtcatggaattacagaaggaacactcaaggctattaactttcagctgaacatctaaaactgagtggaaaaatttaagaaggaaaagattttctctaccttgaggaatctttggcctgtggaagaaagagatttcctaaaagaacatgtcagtatgggagtattaaaaaaatatgtggagactgggctggaatgaagaatttgagattccaggggaatgtgcagaggatttgtttttttcattggttcatagacatactcattgtattagtccattttcatactgctatgaagaaatacctgagactgcgtaatttatcaagaaaaagaggtttaatggactcacagttccacacagctgggaaggcctcacaatcatgacagaaggtgaagaaggagcaaagtcatgtcttacatggtggcaggaaagagagcatgtgcagggggtctgccctttataaaaccatcagatcttgtgagacttattcactatcatgagaagggcacgggaaaaacctgcccccatgattcagttacctcccactgggtccatcccatgacacatggggattatgggagctacgattaaagatgagatttgggtggggagacagccaaaccatgtcactcatctaagaaccatgtgaacagtagcctgaagtactctaggtctgaaaattcctagtttcagccttgccactgactcacactttgatattaatatctgggtctcattttcttatctgtaagatataaagtaagtttctaaaactgctttctggtgccacaaatctgtgatttggggtatcttgatatcactatagcaagagagtcacagtgttgaggtggtgtttggggtgcctggactgtcaagtggactgagtcctggctgagtgaccagttcagaggacatggactaaaatagtttccatgaggaggaagaaaaaaagtccaacattaggaaaataatttgtagttgagtgagaatagtttgtcctgtggggtgaattaagtagatgatggtaattctgctttcatataccatggcatctgggaaatggtggaggagacagaatagtctaaaccagcacagctgtggaatctgggagactatctgcatttggggctggtgtgaattgtgggtttggagaggacaagaaatcacaatgagcagtgtacttagagaactgatgtcagagaagccagcatgtgacgtcaggcctaaggacagacacacgtggggatcttctaacccaaagaaaatgtggtgcaggctgggcatggtgactcatgcctgtaatcccagcactttgggaggccaaggtaggcagatcatttgaggtcaggagttcaagaccagcccggccaacacagtgaaaccccatctctactaaaaatgcaaaaattagctgggcgtcgtggcaggcccctgtaatcccagctacttgggaggctgagtgaggcacgagaatctcctgaacctgagaggcagaggttgcagctgagatggtgccactgcactccaccctgggtaacagagtgagactctatctcagaatgaaacaaaacaacctctaaaatgcagagcaagtggcaaacatctaatggatattttggagtttcagagcaaaaattttaaaacaggagactacccttcaaggaacaggacaaggacatactgcagtccctggagttgtggtaggatagcaaagcttaacaacaggaaagaggcagaagcccatttactagaattgaagtgaaacacaagcagtggcagacaagcagaatgacttgtctctgagcagtgtgaagcctgcattaggatttttctgagtgccacctacaatcagggtgggtttaggagcctggccttggactaaactgagtgatgggcataaagttgccacggctctgtgtaggggattgacatgagggcggagaaccagtctctgcagttgctgagaaattcacaaagtacccaaggactctaaattgggcaggctgcctcaagacaaaccaagaagtctaggaagagtgtactttttgttctcagttcttggtttgcttcatgaagttaacaaaaagaagcaatagtcctaggttcttaatctctaggtccttgaccttatgcttacgattatttacactcataaattgtcagtgcaatatgactccctgacagcttcctcctccttgcagtataggcttttcttcttgttgacaataattctgcaatccttacactctctgtgccagagatggtgcttggcattgtaggtaccatgtttaacactcaaagaaccctttgaagtggctgcttatccctcccgcatgtggcttgaatcagaattcaggcccagctcttatcctgacaaagcccattgttttccattaagccatcctgactttcaacttgaagcagtttctttcctgtttctcaatcttattttaacaggaacggtgaagattttcaaaattccagctactgtgcctagaagtgcaaaaatgctcttttgtatttgcttaacctttaactgcttaaaacaaaaattcgtgtttgttgtttgtttgtttgaaccataagaaatgcaaatgcaacttagaagttgttctgtaagaccacacaaccatttttaaattcaaagacttagctttgaatcttggatttttagatgatggtcatacatgtgcatgagggtgttaaaagagccttggtaattgtgatttctgatttcagtgttacagtctatgactattgcaagttctacattgttttttctacctaatgcttgcccttctgccttcttttttaaaaaagaaaatataatgaacgtggtctgttatttaaaaagtgtgttttatggtgcagttcatggcaaatggtgttgagtggtgatggaacagtgatttttggaaataaactgagtagggcaagaggagaaaagaaggaattcacatctgcacccttggtttgcattggaacacaggcagcagaggtgggtgggaggtgtttgtgctcttccctgtgctcaccgtgggtggccgggcctgtcgagaacattattttatttatcctagaggagttgctgtaattgttgaccagaactactggcatttggggttcacacatcactggactcagggtctgttggcatttgaagagtaggactcatggtgattcttacctatcgtgaaaagtgatgtacctagttcccaaaatggcttggtttatgaccacaggcaggccccatccttagggctgtgtgtctagaaatcttgtctgggcctgacagcttaaaagcctttggggggtatagcaaagggaaatggttaagaaaattgtgacaaaactaacctgtgaaatatcccacagccagtgaaaacgtttataaagagtctgcagtaacatggaaaatgctgacgttataatggtctaaacggagagagagagaaaaaacaaaacgaaacaaaacaaaacaaaaacagaaagaaagagaacccagaatataacattttgcatgcagaatgattccaattatatttttaaaatgcatagcagaaagatgaaatggaaagataccaaaatgttactagtagctatctctgggaggcagaattatgggttcatctttctttgctttttatatacatattcttaattttactaacgttaattatccctaactttagtaagcatatattacataactagggtaaaaaaagcattttcacagtaaaaataaaacttcttatattttggggaaactcccgtttgtggatcggggaaatttgcttgtcccttgccattctggcttcgcagatggctcctgtttgaccagattaacgcaggacattgtgttcaagaacacctacctatctgataggagtactgaggtgctatagaagatgacagttttaatagtaccggatgaataataattttaagagatggaattgacttatgaagtgtaaaatgacatgatttttttcccagttagggtgtaggatgctttattatctgtttatgagagacctgtatttggaacacttcatcaaggagtgtgttcaggttttttcaacctagtgaaattagggcaatcctgagaaattttgcagaggcagaaaaacaacaaaacaattccagtaattatgggtcatttataccgtgctcagtgcattctcattacttcttcttcataacatccttatgaagtatttttacccctaacacagatgtgagaatactgaagtatgaggttgagtaacttgcccatattccagaggttgtccgtttgtgtatttgggatttaaatccatgctgtttgtctctagaacttactatgctcataaagtttgctggggagtctagaaaacttcatgcaggaatttatattaaaccatctgtttttcttttaaacgaaataagagatagaagcaaataatacttggatcagtaaaaacacctgacaaaagacagcacttttcagtttgtagtgtgttttctttttgacagtatcaaaatggaccaaactagaattcataaatttattagatattttaaaaggaatttatttgaaatcaggagaaaacttacaatttttcaacttagcattgagtttgtgtagacaaaagcattggacagggagggactataggtaagctgaggaattctattcctcttataacagaggcctcatgatttatagcatctctgactatggggaaattatgtaaccttgtaagtccagtatttctcatctgtaaaatgggattaataatacctaccttatagggttctctcaaggaatggatgaggtaatgttcataaagtgcttggcatggtgcctaagcgtgggaatagtgttcattgatgttagtgattatttttattactgggggttaggaagtatagagtgtggatccagttctgctgctaacattggccatgaacaagtcactcaacccttcttgttcttagactccaatgggaataattacaatgccctttttactgataagatgagaatgaattgaaattatgtatgagtcaactttttgaaaaagtatgaaagattctaccaatatacatgataaagatggaagggaatagcaggcaggtcagaggggcaaagtagttaactttctttgggtttaagtcctaactgggacttaaacacaagtccagtttgcatagaacaagttgagtgaattatactcaatcacttgtgagaaaacactgtaactcagaaacccagcattactgctaccaaattttcctgatgtttggcctctcatcatgaaggggcctgaactggacctggcgggagattttattgcattttttccccaggctgtgctttctggttagtaaagtgtcccggacagacctggctgaggttttactctttcactccggaatgagaggagaatggaaatagctcatttcttcagccgtgcaagccgtggaaacatcaaatgtgtgtgtgaacttgtccatacccttcaggccaagtgcttttaaaaattacctgcttcctaaattgccaccagtgctctgggaagttttgctgtggtaaactcccatcaaaattcctgactattctcacatcccctctgcaaggccataatgggagtactgacgggctttggctctggaagcaaacatttaagagtcagggcaaacaaagaaaaattatattctagtcctgctgcagtcattgaaatgggttcaagatactcagtgtgtttcctagtatagatgacatgctacagcaggggtgggaaagacacaatgatttctttggaaccaggggctgatttgttgttggagattataaatcttttcactgactgtttctcaggctaccattcaccctagattcctacaggaatcacattgcctccacggaacagcgccagccccagtgctaatcaaatttaatctatcagcgaggactgctttcctacaatggacattggggggcattgcccattaaaatgttgagtcattagcactgtcttcaaagcaaatctgaaggcttgataggtgctactatcttattattattttaaaaaagcaattgatatgggagtgggaagaggggctgatttgaacttaacatgcccccttggccacccctccccaaaagatgatttaaaaacaagcagtgagccagagaattttcaaggctaactttctcacgtggaagagaaaaattattgcaatgccctttagctaagtacactcacttcagcctttatcgatggcggcagtcacgtgtgcacctcttcatgaggaagagagcttgaaacaatcacagggcagaacctccagagactagagctgggatgagctctaatagtagggcacagggagtacctgtgaggtttttgtttttgtttttaggagaaggctttttgaggaagtaatcttcctgcccaaaattgaaagttaaatcttttccatcttatccatcattgctcttaacagagacagttgatattcctgagttataggagacctgcaagtctctacagtaggcaactttgtagaactcatatgtatagatagtgggccttttacagtttagcattcacttgagcatatgaaggaataaaaaggagcaaacagatgggattatgcaaacatggtgcattaagagtttctagtaaacttttagcaaatgttgacacagaattgagaattatctgaagtttattctcctgtccaaagtatccaagaaagcaattgattggaaatagagcaggggaaattttgatgtgaaccataacaagactaataaaatgtagaaatgacatataaccaggtacagaaagaaagcagttacgtccaggataagagcaaggatgtaattggctttgtgtgttattttcatgtgtgtatagggatgcatatgcgtacacactgaatgggagctaactgttaaagtatgttgtataaagttcgatctgtataaaatgtggtttgtactttgaactcatatttttttgttgcttataaagtttagaataaaataaccacttattcctgaagggtatttgaactggtgagtagtcacaactgtagtcatgatgatttggtgtctagatttttatgtaaattggtacctggataatgcattcctatttggctttagtaatcttcatacaactgtgaagtagagaggcacaagctttaacaaatttagaaaaattcaggtcacctgacaaacgcagtgtccccctgggaattaacctctttgtaaatttggcactatgactcacctttgttgatcctttcatgactctctccctcttcaatttaaattgtttcttttatgtctaatgacattactccagttctttgcttggtgacctaacctttcaagtcccaggtaaaatgcaccttcttttgtgaagatctacccatttttaaatagaactaatttctttcatcaatatttctcatagaagaatctcaataatgatggctaacacttactgagcattcgatatgcactgggccctttacaagcaatagttacttaagctgggcatggtggctaacacctgtaatcccagtgctttgggagaccaaggtgggagaatcacttgaggccaagaattggagaccagcctgggcaacatagcaagtccctgtctgtacaaaaaatcagaaaataaaaacaagctgggtgtggtggcacatgcctgtagtcccagctacttgggagactgaggtgggagaatccctggaacccaggagttcaaggctgcagtgagctatgatcgcacctttacactccaggctgggagagagagagaccccgtcagttaagaaaaaaaaaagatagttacttaatttttgtgttgatagtcaatcttatgaggcaagtactattattatccctagtttatagatgaggtaaatgaagctttgagaggtttagtaaacttgtccagagtgtcatacccaggtagtgggaaagccatggtccaaagccaggtcttgtggattctgtaagtgacctcactgtttgctgaagtgacctcttaatcactttattctttctccattctccctccccagtatgtacataggtatatataatttgtggtcacattgattacagtttggtatgtatgccctcccaaatgaaagtgtgaggttcaagatagtaaaaatggcatcttcgtaacctctgcaaaagaatattttttttaaaattgactcaaatacagatatgcaaacacctgtcagaaaatttacttaggttgttaatgaatgagggaaccaagaaagttgttgtaacagatttgtagaaccatgaatttatatggaataaaaaaatgctgaaattaatttgcaaatggatcaaaagtggaggggaagtcgattgaacctccactggacataatttatttgcatctgtagacaaaaattatttgcattgcttttcattatctataagttacaaagttatacaatacaaagaacataggctcatggtttagataggccagaatccagattctaacttccaagcttaatgtttgaccttaagtgaagtttggagaattcagaatatcacacacacatagccatacacaaacatcacacagagattttgagaagattaaaggtaataatttagaaaaagcccctggcacatagtaaatactgctaaatattaggcgtgattgttagtagtaataaagcttctatcagagctctaacatttagttattgcttagtaaatgtttgttgagtgactaaatcaggagtgaacaaacttttccctgttgaaagagttctggacatgccactcctgttgtagcacaacacagtagatggtagttctctttgttagtgtttgaagttgcttaacactggaattgcagttagacctagatttgattctcttctcagccatgtactagctgggcaatcttgggcaagtcaacccatcatgtctacaacttggatatacaaaccctgtgaaaatcatgaggaaagtatgatatactctgccaaggtagtaagtatgcatttccagagagggaagaaagtagtctttcatgagttctttggttgagtgggaactatgtgagttttgtggctaaaaagtgaaccagccatttctgcaagggataaagaggtagggtaaaatagttctttattgttacaaaaccacctccagagaaacaaatattaagtctaataattattgtattgaattaattttgaaaggtggttaactgttgacatcatgttgtcttacaaataagcatttgtcttcaaactcacataaatgatgtcccctatgtagtaaaaaatggtctttttgtcttaggcattgatggttcttagaaagtaagtttatcaattcaactcaaagttgggaaaaaacaatacagaccattaaaagccaactaaaatggccacacactttaaagaaggcccattagccatgcaaatatgaagtcacctgcacttccaataagcacaattaactaaacaatgaagcccattaacaactacttgtgggacattaagctttgaggaactgggctttgatgagttggaaaggaagaaaagacagaatttgttctcaatttgggctgaattttaataaaaaagaaatcttgtagagtcagttagggtcagttaatgctctttgtaaaccccactcccaactctctcccctacaacattaaaaaaacaagctcgtgtgtttgatggctcttaatgttctttctactggagtgagctaagtgaagacatgtttgaggccgggcagtgtttggaaataatccacattttgttcatgatgttgtaatgattgatttaaaactatgattttaaaataatagttttaggcatgtctctattgttttttccgaactttgggttgaattgataaacttactttttaagaatcagttgtggccgggcacggtgactcatgtctgtaatcccagcactttgggaggccaaggcaggcagatcaccagaggtcaggagttcgagaccagcctggccaacatggcgtggtggcagacacctgcagtcccagctactcaggaggctgaggcaagagaatagcttgaacctgggaggtggttgcagtgagccgagaccgtgccactgcactctacctgggcgacaagagcgagactctgtctaaaaaaaatatatatatgtatatcagtcatgcctaaaactatgtgtcccattttagaacagaatctgctcttagatctctgtgtgctgttttgtgtaagaggagattgtagaagctggagtaaagcagacattgagcagtcatactggagcagagccaccgcctatccctgtacctttgccctattgcttaatctgagtctcagtgtctttgtgtgccaaatgggaaaaagagcctatcgctgtaagggtcaaatgaaagtgatccatgtaaagtgccctgtacagtgcctggcttctcaatgaaaactgctgccatttctcatcatcatcatcatcactattactctattcagccaaaaaatgatgttcgtgtcctgatcagtggtatagatggctgtaagatagagctacgggagactcggtgtaggatgttgtagttcatttttgactacttctctacttctcccttacagtagacatttatgtgattatcatgatggtttctgtttacgataaccatcaatttcctgttgccttcacattctctcctttgtattttcttctcaaatggatttggttttgtcactatatacctagattcttagcaataaattacaaaccaacctttcctcaagaatccccccacctcccatcctgtagggagcaaccccacttttcctaaaattcagctttccctgtggccctctgttcctcttactgggtagagggagaaagatgttttccatgccctccaggttcaagccccatagtctgactccctgaggttcagaccctaatcccgctggcctttcaaatcttcttctgctcaccttcatagtgactctgcttctgccatgcttgtttactcacaagtccctgaacatgctaagtgctttcacaccactcttaatagttctctagatggccttcttcctgagtttccaagtcttgtgcttattttaattccaagtgaggtcccagcttccggccactctcatgcgtcttttttctgagctcctaatagtgccaatcctttgtctcgtgcatttgaaatcgacatactaccttgtgttctgtacccactgcaatgttacctgtccttcttcctagcccataggcagtgctggatattttttccttttactccatagcacctcaaacattcttaattataacactttgtgcattatttcataaatcacctatttacatatcacatggaccatctcagactggctggtagctgtctctccagcaactagcacagtctgtggcccataaaaggtgctcaataaatgcttatgaaatgactagatgacagagcagctaccaggcatgttcgtaagcatttgttgaatagtaaattggcagaatccttgagggaaccatctttattgcttctttgtcttctttatacataccagggtacctggtacacaggtaggtgcttaagacatggttattgacctactgcttgaccaactgacagaccaacatactgtgtggaataatgggcactcagtacagtattacatggctttttttctcaaatgcaaggccattacccagaattttaagctgattaacgtgattgccatgttagaagggagggaaacgtttaaccctggacaatacatctccagtgggatatttatgacccagcgatatgtcatctgagaggtttcagtggctgacacggtagttagcctgatgcacataaaaacacctcagatggcactaggagaaggaccatgaattcatattgcatgcagtgctcaaagaattaaattgttaccacttaacattcattgaatgtcggcactgtacttttgtaagaggaaaaaatagaggagacacactccgtgcagtgggctttgttagctataattagttggtaatagaacagtgttgatacagcagttcagcagttaaagaaaagcagtgcctgtggtacaaatgtgaatatctttatacatctggttctgttctgcttactgtgtttcagcaccattactgttctggggcataatggctaaactaagaattttaccagctcctagtttaaaaaaaaaaaaaaaaaaaaaaaaagaacaacgccatttctggaacgccttagttcaatcacatattctgtcatttttgtttttttgttataactggaattctggcttctttgttctctgttggaatagatatatctagaagctcagtctacagtcgtaaattgcaatttcacttctctttatttaaagtcttgctaattctgattatatgtggatggatgtggatggcatttatctttgcattgtctgggaaagcataaaataaaattgcaaagagaaaaacaggtttggagtgacttcagaacctgaattgtttctgctctttcatcggtaaatagtggtgtgtaaactgtgtggctaatcatggaactttggagtcatttggtcttgcctctcttttcacactagagggacagaggctagaagatgggaagtgacttgcccagggtcacacagctgattgatgatatatgtagtaagaacacaaaagccactggattccacagccagggctctttctaatgagactcatcagtcaactgaactagtccctctgaagagacctgtatgtggaagcaaaatccatatgtgcatgtgacgtgagatccttgagaatgaggaacctttatatctttatcagcattttaaaaaacaaacttctgtattgttcactccctgtaatatgcatttttttcatttaggagacttatttttatttttttggtaaacttaggagacttatttagtttaggagaagtcattacttcacttctcatgtaaattatccatgactggatagagagcactaaaacttggatatttttgacaactaattccaataattttggactgtctctctagatattaatggttgccagagttaggtgactgatttgccagtattttgtcatttttaaaattatttttattctccaagtgcaggtatattttagcttgcaaaattaagtgggtggaaagataagtgaattgaaagttagaaaatctgagttctacttatggctcagattcttcatggtaaaatgagtcaatttaaaccagatcagtgttttccagagcatggactatgtatcattagtattaataagcaagacactttagaggagacataccttaaacaaaaattgaacacttacatgtttattttattttatttttatttttatttttttaagatggtcttgctctgttacccaggctggagtgcagtggcacaatctcagctcgctgcagccttgacctcctgggctcaagtgatcctcttacctcagccttctgagtagctggaactataagcatgtaccaccatgcctggcttttttttttttttttttttttttgtacttttggttgagatggggtctcgccatgttgcccaggctgatttcgaactcctgagctcaagcaatccacccaccttagcctcccaaagtgctgggattacagacatgagccaccgaacctggctcgtgtttattttaatgtgttactacacattaaaaaagtaaaaccatcatatctgactgatgacttcaaagatgttgtttttcagggcaaaactaaaaaatatttctgtaaaaactattaagcatctaacaaaaattaaggactagtacaagtgagtaaggcaaaggccatgaagatgatcctcaaagaagtggaacacaggatcagatcatctctaagttcctttaaacataaaagttctgtaattctggtaacttaaacctgttatttatttgttcattgttgtgctggcaggttttacttgtctttatcaaatagtatgtccaggttggatgatagaacatcacaaatataagtttagcattaatgctatctaaattttctgggtgaaaaggaaagccttgatatcacattggaaagtttttagagataaagtcagtgggccaggcaccgtggctcactcctgtactcctaacactttgggaggccaaggcaggtggatcacttgaggtcaggagtttgagaccaccctggccaacatggtgaaaccttgtctctataaaaataccaaaattagccaggcgtggtggcgcatgcctgtagtcgtagttacttgagaggctgaggcaggagaattgcttgaacccaggaggcagaggttgcagtgaggtgagattatgccactgtacttgagtttagacactgtctaaaaaaagcaaaaacaaaagtaagaaaacctcagtggaatccataagcacagcctgaggattttaaagtggaatgggggttgctaaaagcactgaaatccctttaaaatgctttgtaaggatacagttctattctctcactgaattataggttgattgtatacacaaaggttatactgcacacatggtctaaagaagaaatccatgtcacaacaaaccacatgacagcttttctgaagatctaccaatgaggtttgcaatactgtattcatttgttattggaaaaacaataataaatatggccggaagaggaatcagaatggaagccataatattatcatattttttgtgagtaaaaaaaccctaatatgtcaagactgaataaacaagaatggtttatttgtttgaatatgcagtgagatatgtaagcatttgatgatcaagcttcaagaacaagatttgaggcttggcacaaaacttggaaagttcattggaaaatggtttaagatgatagctcaggccttctctagaaaaatctgccaatttgttcagcagtgccacctccccatggcctgggctagcatctgtctttgatgaacagctcattggttcatgaattcacacagaccatgaattctgacactacaaagggagggattctccccagtgaaattgtatctgggaggaaatagccttctgaggacattagacatcttatcacacaaggaaaaatggaagaaactgtagctactccactagagtggagatgatttccggggattataatagattgttttcaaatagttgaagaactgtccaatggaaaagggactgggttcttattttcttgttatttcagagtgcagaactaggattaagaaggagggacaggcaggaaataaatatattaaagaccatggattccgctcccagtatatgctgggtgttgtgtatgtgatttcttttaattctcacaaagtccctgagtgagtggtagatgttattatctccctacaacagaaaaagagatggaggtcatagaagttaaatgatactactactaatagtagtaaaaatactattagttactagtaaaaaaaaaatactaacatttattgggtatctacttcatgtcagacactgttctaaatgctttgagtacattatcattttttattctcataacaatcttaggagataggtactatatttatatctgttttactgatgagggaaccaaggcacaagggttaagccccttgcttggtgttgcatgttaataagttgtggagtggatttcagagccaggcagtctggctctgcagccaaacatccttcacccttacgctattctgctactctatttttggagcatttgttgtgtgtcagatgctgtacttgatagtttgcatccacatagcaacacagaaaattaggcattattattcccattttacagatgagaaaaagtgaagcttaaagaaatcaaggaagttgcccaaagccaatgactgacctaaaattgttacttagtcttcaggttccaggccaaagtctttggaccatgctcagctttctcagaggtacagaatctgaaacagaactttctaacaagtaaagctatgaaaaaactaggatgggttgcacagggggaggaaggagctctccttctctggaaacctcagaatgaaaattgaagccaggtgggggtggctcacgcctataatctcagcactttgggaggctgaggtgggaagattacttgagcccaggagttcaagactagcccaggaaacataacaagacctcacctgtactactgctaataacaagaaaaataagctgggtgtggttgcctgtgcccataaccccagctactctggaagctgcggtgggaggattgcttgagcctgggaggtcgaggctatagtaggctatgattgtaccactgcactccagcctgggtgatagagcgagatcctgtctcaaacaaacaaacaacaaaagaaaaaacaaccaacaaaccaaacaaacacaaaacattatgtcgtctagagggaagggatagaggagattcagatgtcatgtaaaacattgaacgagatgccccataaggtttagtcctgctttgggattttatgctgctatgtttttttctcatcttcccatgtcaccttgttgtcccccaggtgtactcaaacatatgtgcaaatatcactctaatatttgaatctggctctggggtttagattgccttggtaagatactcacttgctaggatatttgacacgatgccttaggggaaatgttaggtcatttgagaactcagcagcataaacagtaagtggtaaagttgtaaactaaggatgaaaatatagtgtgagggccttcacacaatatgaacagataggatcttccagtagcagttggagtctcccttagatgtacttttatagtgaaaatgtttggctgtcttgacttttccaggtgtttatcaaatgcccaatttgggaggagtagtttcctgagggtggtctcagttttaattatctccactggaatttgcccactctgctagaggtcttattttcaactctatgcctgtgggtggaaatgtcttcttcctatgagctccaggtgatatttgttgtaccatctcacagagtggctttggcatgttgcactgccttgtcttctgaaaccatctcttgctttgtacttattcctatggatagcaaagattctcagtgcctctgggtcaggatatctatataaagtctgcatctgtatacgcctcacttcccccatcccctgccttgaatcgatcttctgtgcattctccctagtgtctacacattatttctctttgatggcatcatggtggtggtgtagatgtgcgagccttctttgcttgtcttgctgtctactttggactcaaagctgagaagaaacacttactatttcagctcaaagctgagaagaaacacttttcccatttttactgtcccctctactcagctgttccttggactttgatatttaaatgtttctctgaaggaggtgggaggtggagaaagaggttgaagtgattcagaaattgcctagtgttccccataatgtcagaaaatttattgcctagtatgaagtcaagatgaggaaccaattatgtaccatgtgatgattggctactttaaagtgggtagattcatagaacagggaactatttacaacaagaggtttacatctgtgctactttcagtctaattcaaaataatgacaatgatgtctgtctgataagctgagatgacctcccaaaggattttgatgcagtagctgggtctgtagcttagctgagttacagaaaaggagaaatggggctgtgtctgtatgttagtattagaatgaaagctagaaaacaaacactagaataggtagatattacatttattcatatatttagagatgtagtggctgatttattaaattttcattcaaatgttggtgcattaagtataaatgcaaacagtcctattctagtgagcatttaactattggtatagggatattgcttatcacttttagagagtgacacagtcagccccagcagggaacagtcattcattctctgggaaaactacttttcaaagacaggaaatgttgctaagattgtaagcaccgagactgagtgtaaccaagtctcagtgatggaaaggaagacatcaaacatttttacatctaaaaaagcaacatcggctataatgaggagggtttccaggttactaatgagatcacagtggattagtgaattttctacgtggtaacagcatattaatttctaacctttctaacagaaaaaatccattaattttttgcggaagttaaactttctttttgggcttccaattagacccactgtgataaccagttcacaattccttcctccctactctcctcctttcctcccttccttcttgctcctcttactttccttctccgacacagataagaggaaataaaaaggttagtcattgaagaaatgtgggactatccaggttgcacactgatctcttctatttccctcactgaaattgtcattgttaaaacagattgtttctttaagaaaataaataaataaaggaaaagagaaaacaaattaaacaaagcctgtagaggcaatatgtttagggagtcttgtgtggagctttcagtgtgttctctgctgcatgttaactatcaagggttggggctgggatatgaaatattgttccttatttaatgtttcacactctaatctctgcattgcatatttgcttctcttgtgaccttctctttgcatttataactgcttcttttcacctataatccgaaaataagtgtacattcctacagagaaattaaaggaggctgtcagtgtagagttaatatagttaaagcatccttaactctgcgacaaaccccttaaataattaaaactgtatgcttgaagagtcagatttgcattcctttaccaagtttatttagtacactttgttacactcaattaaatgaggatgttctgtttcattttctttgctttgggttgatcattttgccttttgattcttatgccctggtgtaatttcacagtgcttaggtctctaaaactatacatatattaacgtatatgtagatatatacatcccattaaaaggcttaatatttgtactgaatagaatctttgcccaaggcatttgagcattcctggtaacctcaggtgtaactgggactgcagataattcatcgcagtaaaaacgagtttgacaaagttcttttaacatccagtgtctttttttttttttaatttttaaagctctgttattttggcatcaccttctctccctacggtttgatttgtgaatagcaaaaaccagaagatacaggtgttgaatggttgtggaaaggaaattaaatataagtgctatctctccacatctcagttggcagagcatgtgcagactgctctctgtaaattagttcattgcttaagttatgcatgtttaagaaggaataaattagttatctatttcctaatgagtagtgggatcaattggagcatgatgagagagaaatagcataattttgcttccccagttgaggttcagtatccctaaacttcaccattaatcactctatcagtttcctgggttatttcagatctatatgtaagatattcattccttttaattttcctaccaggtaagtaagtccttttgaatttgcccagtgggtttgtaaatgggtgatgctgtctctgttacacccagaagtgtccttaattacagtgggcccttctgcctttgcgtcagtttgtctgggtgcattcacgaataataataaatatgtatgtgcgacgacaatttcaagggttctaatatgtttaactgttatgggatctgttatgtctactttagggtcgaccccatcccatatgacactccaaaaccagcgggccacacgcggtttgtctgcatctcagacacacactccagaacagatggtatccagatgccttatggggacatccttctccacacaggcgatttcaccgagctgggactgccctcagaggttaagaagtttaatgactggttaggtaaggaatgattgcgttctggcggccccaattaacctttcccgtccgagtgtcactcactgcgtcctaattgaattagagcacttggaagccagctcagccatttctcgtatgatatgcggtggtgtctagctttaatccaattctgttaattaaagatgaatttttagatatttaattttactgtgcatcctttcagtgcctggccttggtggctctggggcaaagggatggaaagctttgaaacccatctcatctcactcattctgctttaatgagggcattcattggcacacaggagacctagaatcatatttttaattcattggctctgcaatctttttttccccagatattataagcaaagatatacaaatgacctactagtaagagaacatttctaagaaatgaaggggttataaaagtccttatatgaaacaaaattcctatagcacagtgctgcttgggagcggatttcctaagtgagctggagggtgttctagacccctgaaaacatgagatatattactgtaaagtaaaaacttgggatgtgaagttgccctgtgtcctgtaaaaaggataatagcaattttctggatattgtggaggcacccacaggtcagttactgcaaaatattggatcctggttcctcttagcggagggaaagaagtgcaaatgttctgagattttagaatccctaaagacgaaagaattatatagtaaagagcagacgtcactctgggagcgtaacattgtcaataatatgtcagccaacaaaaataacttgggagatttaggcaaaaacattacaactttgttttccatcaaactaaagcagggtttgaaaattttttaaattttcgattaaatgataagacgtgttagtggaaagatgatattttagaattgtaagcaataaacttaactaataacataattattttgatttttcatgtgactttgctcatctgttcacattttgtatggttgacatctgagtacatatctgctttttgacttttggctgttttcatttaatagtatttattggtaagacttaaaacgtttttgcataattttcatattctttttaatagcagcatggcattcatatggttggctatgcctttctttaataagacatctctctaaaaatgagcatttaaattgataacaatttttcctctggtagctagcactgaaatgtgcatttttgtttgtgtatgtcgttttgtttctattgatttatttcttagggaaaaatactatacttaatttgctaagtcaaaggatatgaaattctttatggtttttgctacatgttggcatgttgcttttcaagggcactgtagctgtgtgtttcactagcagtgaatgaatgtataggtactagttttatcatggtcttggcagcattggatgttggagcatttatattttgtgctgttttagtaggtacttaatcatgttatttaaaatggcaagatattttaaatattatttagcataatctcatttttacagatgacacagagatgtagagaagttaagtgattttttcagtttcatagtggcagagttggttctaaatccagatcttttcgcttatgtcttttttctctacaataatctctttattttagcaactttcatccatgaactattagcagttaaaattattgttggtaaatcttgagagttttgaactagtctgtgtcaatggaatttcaacacagaaattatcgagctgcgttgacaatgttgatttttaaaggaagacaacagcactgtgggaagtgtttatagaaatggaggacaggttagggctggttataatcttgtttagccactgaccttgggaaactgagttaaccttccttttccccttggtttccctctgcaggacgaaggattaatactacttgtctttctggattgttgtgtagattaatcagtaaatgattgctgctagtaagtttttgtgggccattaataactgaatggggaatgtgccaaatgaaccatcaaaatatatttaaagggtaaaaagaagaggccagaggaattatttagtagatcagaagtaaacactgggagattttataagggaaagtactccataaatggaaatgtgtcataactaaggaaatacaatgataaggaaataaaatgccaaggcacagctgcatggtcagtgccttctcttcctatttcccctatgatctggtgagacaggaggaagaggtttcagcatgggttgcagaatgtgagatcgaagggagccctgggatatggttagagaagttgggatcccatagagaaggccaagaatagctcactgttacccaggcaacctcatggtgctcagagggtaagagatggtgtgtgataacactctaccacttggctcaatgaggaccctttctgaaagggtgcttctagcagcagctgccaggtggcctggcagagtggagtcagaggtcagatcaatctagggttttagggctttttccataatagggcatccgactgtcagtggggcatgggtctcacagatttggtaggcatttggagtccactgaatctctgatttctggctttctactctagtgtagactaccctgattattgaaaacaacctgactgtcccccaagctcctttattctgtctctgagctaagttgtttctactataggccaggcactccctctatacctgtaacatccttctgaagttgctaatgttatccccattttacccaaggtcatttagtatgtaagaagctcatagtggctgagtatccacccaagtacactcagctagtagacatggggctgtctgactccaaagtgtgagcccttttcctttgtcattctgtgatattatgacagggcttgtggcatctggaagcatgcacatttgaagcttgtactagaaagtgctgtagcttctggcagcttcatgtggaagttgagtagctgtttggctatgtgctaatattgcacgtatttgaaagatgtgtttaagctctgcccatcttaaatctcacccttgacttagcaactgcaaggccagggaatcccatcatgagttctttgttggttcagagatgatgatccctggttaatctgtacatatgtcacctagtaggagtaacaggcaaagtcattaacatgcgtaatttatcagataatcgagcacagcttcatcttaggtcataagaagattgaactcaaaccagatatcactacaggatggaaggggagtataacatgtaatgattatgagcaactgggaagacccagccagttttgaattcactacctttgttaagttgtgtaaactctcaagccttgatttgctcatttccaaaatgggcatcataatgataatacaccttacggtggttgtgaggatatgctctgtgataaagctcatactgttcttagaacaacctctggcctgtatacaactttcaactaatagagtagaggaaaccaacagagccagtggcatagaatcccaaaagcagaagttaaaaggagctggccctgggcatttaaagagggatccagagtgtaaagagggagcaccaaaatgtataaaaatgagcctcccttataacagtgacactaaccagacagaatgttaggacaggaagagaccttgaaggccatggagtcctacctcctaatctgatagaagtggaaactgagactggagagatttaatgaattgtccacggtttcgcagataattaatagccaagttgggatagaatttggatggggcaggatggggtgggtgaactaacatgtattaacatgtattgtctatgggaggtaaggtccagatgctgtacccctgcattacatgtgtcatttcatacaacccccacaataacttgtgaagtaggtattattagcttccttttaacgtgtgaggaaactgagccttggtgaacttaacagttcagcagtgacctcaggatttggacttacgtccatcagactccaatttccaagtgtatttccttacctctcttcccagagtggggcttgaaatctgttggaggaactacatcctgggtaaaaccatggttcttcgaataactgcctccttttaacacaagtacttacacgtacatatgttcagggcctaaggtggtttatttcctgagaaagctgttttgtggcacagcctctctacgtaagctggccgatggaagagcattatgaggtagggaagtattctccccatttggtgtagacaactttggtgagttacaacaaagcaaatacccgtaaagaattctacagatgcagccagtcatgtaagctccaaagaacagtctaaattatgttatgacattagcatttcattgaccagtcctggaaatgagtagctactgatggtagcctggaaatatcgtctttttgggcaagcatttcccacttatgaacacttgaaatgatcaggatattctaaaaactgcagctaccaccgcattggcccctttcctcccaaatctctaccatggattggggaatgaaactttgaatccctatatcagacagctggagggagtgacagagcccctgttttccatctctccccagtctggctaatcagacatcccagtcctccatttgcccagacaacctgtgcctctcttcacctggctgctgcccgtagtgctgtcttcagggcatctagtctagggtcagagggacaagtggcttcttattgtcaaagatttattgccagagtatatggagagaggtacagatgaatccttcttaaagaaatactttttaaagtgatagtcagctcctattgtctcattaacattttagctaagatgtgttctaggtaagccatgaataggctttggtgagttgaactgggaccctgccacctaatagttaataacattttccttcttatcttagcaaaaatgcataccaatcccagacttggcttaaaaataaacttgtgaactagataaagtacctgtcagttaaaatgtgattatttttattgccttgaacatcagtggcttctaataccacattctctaaaggtacattttgcaaggcctcttaccatgtgtgttcttcctgcacgttggccctgtgttccttccacctgtgcttctttgagattacttactgttccctcaattttgtccctgttgtgctttcatcttcagaatacttttggtagccttcttgaatattgcagtttatgctcatggatgctacacaaataggcattagaagatctcatcgtttgattgcacatccaccttcttatttctgattttcccttatgcccatacccagtttcttcccatttttcaaatgcaacatgtcccttcacacctctttccctttgaaaacgctgttcccacttcctggaatgaccgtctctaggagaactcatcctttatgacagattctctttcacagtaagctactttccttaacacatcagtcaccagtctgtgcatcccttcccatggctatgccattgtttacttgtttctctgccctaccagacagcagtgtgcataatgagtgctcttggtatgcctggttctgagtatagggcctggaacattgttggtgtacacaaatgtttgttgaatcattgagtgagtggatgaacataaaggtacaagatgttttttcctgcctccgcttttggccaaactttaaaattatgtatgtatagtgcctaatccttccctccccttcctttttcttttattctcaaagaacttataatatcccattggctgttgttgttgattcctatatactgtgcagaaataagaagggtatattgttgctgttgagtttcccactttataattagaaaggcagagtttttgggtggtctattctttcagtcaaaagtttacgtataacaatccagtcagtcaaaaattccttttaacacagcatcattgccatgaacttttaattatggcctttcaattatggcctttctttggtctggattgtcatttaatagttccgagcttcagtttctccagccctaaaagggagaacaaaaatgcttcaaggaaaatctcaagaagagggtcattcatatttgtaagagcattttgttagacatggctgtaacagagtgtgactgtaaccaacatcccagattgcagacatacaaatcaatttttgcctctctcagaagactatattccctttctagtgatcctgctattggcccaaagttttggagctggtctttaggaaaaaccttcaccgccaaggctgtttattttattcttataatatatgttatacatgtgcattccttttaacttagagataagtgaaaagaagaaaacaaaattacctatgaacagatgtaactactgttaacattagtgtgaattcatgtagaatgtcttctataaatacacacacacacacacacacaaatatcttttgccaaaatataagtcttacagttgtattgctttgtagtctctttttcatcttaacgatatattatgaaccacttttcacatcactgaatgtggttaaaatactttttcccaagaagaatactttcattgtaagatacacataacattataaaaatccaaatatttgatgtgtgtaaagtataaaatatacattcctccataattatatttccaaagtaattacttactatttgatgtataacatttcaaaattttttctactttctgtttctttttataatatcctcaatagcaggaaatcttcacccatttagggtctttattaaggactattttttaaaattgataaaactatgagtgtaatcttgtaacttaaaaaatgaacacatcatgctctgtgtcagcatagcattctgttgtactgatgcactttttatttagctagatctcttgctagatacataaggtatttccattcttttattattctacttgcactgaagtgatgaacatctttcttgctctctctttgcaaacatccttaattatattcataggatatattcctagaagtagaattgtttcttcagatgatgtgtatttttaaaaaattatgtattatcaaatttctcttcataaagattgcaatttctccatgatactctcagtagtatttgagagtccgtgtcacatatttttgggtaccctcagtggcagcaaatcttcaccctttaaagggttttaaaagatgacgatagctggatgcagtggcacacacttgtagtttgagctactttgaggttgaagcctaaggatcacttgagcccaggagttcgagaccaacctgggcagcatagtgagaccctgtctcaattataaataaataaataaaaacctgtaaacgattttctaattatgaaagctcacatgttcattgtaaaaacatgtaaacaatgaggccaggcacggtggctcacgcctataatcccagcactttgggagccaaagagggtggatcacttgaggtcaggagtttgagaccagcgtgggcaacatggcaaaaccctgtctctactaaaaaaatacaaaaattagtcaggtgtggtggtgtgtgcctatagctccagctactcaaaagactgaggcatgagaatcacctgaacccgggaggcagaggttgcagtgagccaagatcgtgctactgcactctagcctgggcaacagagcgagactccgtctgaaaaaaaaagaaagtaaatagtgatacagaaaaaaattaaaattgccaatatatcctataaagctcacatgtaactactgttaatggctggtgtgtatcctgtggtgtggtagatgtgcatgtgtgtgtgtgtgtattgtgtataaaaaggcagtgtggtattaggttacaagcatgagtattggattgagcctgcctatatttaaatcctggtttcaacattattaattctgtgatcttcaatgtattcatttgtaaaaggagacttattaatgcttagtgtatccagcctctaaagattgctgtgaagttaagtaagataaaggagacccaatgtgtacaagtagtgaatggtcaggaaatgttatttgctgctgtgacattttccgagcatgctgtgcagtgacagctctttcatgctctgttgttgaggttctgttactcctggggagggcaggaattggagagacagggggaggggagaacttggagaaggtggccctgaagtctcttgtgtcatagcgacctgctggcctgtggcccactctgcctgtgcaacagagaaaacggtgacacagtggccctacctggccaccagaaacctgatgctgtccccttccaagtaccccagaccaaacttacatagacctctccttagactctgattaacatctgaaccacagaagcagggcagcagggcctctcctttccctttccctcttccccatttcctgtcctctcccctctgttcccctctttattctgacccactctctctcccctccagcgtcaccacccctccttccagaaaccacccttgcccaccggctcctgtcttaacaatctccagcaccaggctttattcaccaggttaccaagggcagtttttaattaaaaaaaaaaaaaacaactctttcacataatactttccaggcatggttcacacatttaagatttctgattttttgaaacaataaaaaatattaggaactggagctggtgaactgggcaaggtaggagatgccattttaaatagaaaatagaggccgggcgcggtggctcacacctgtaatcccagcactttgggaggccgagacgggcggatcacgaggtcaggagatcgagaccatcttggctaacacggtgaaaccccgtctctactgaaaaaatacaaaaaaaaattagctgggcgtggtggtgggcgcctgtagtcccagctactccgagaggctgaggcagggcaatggcgtgaacctgggaggcggagcttgcagtgagccgagatcacgccactgcactctagcctgggccactgcactgtagcctgggcgacagagggagactccatctcaaaaaaataaaaaattaaaaaaataaaaaaaaatagaaaatagagattgatacctggcaacttttctctagtaaagtacctggcacttcccaaagaatcacttcagaaaggatttgagcagagcagcctcactggaatgtttatagtcatgcaagtttatgattacctaacagtcatatctaataaagaggtaaaggtaggagccttttttttttttttgagatttattcttgctctgtagcccaggctggagtgcagtggcacgatttcgactcactgcaacctccaccaggtagaaggctttaggaagggcagataagattaactcttcctatgatttacaaaggagaatatgccagaggtttccctagagtcaagatctctgattcttactgttgagagtttaatactcaagtagtttcttaatctttagcttgttcacaaaaacagtatctaaaatgctatacttttaagtttttgattcataatttggttttcctagcaaccatcctagagttatgatttattgaaagcttctctttctagttcaagaaatccacttagggtccttttttctatttttttttctttcccctttctcatcatcattgttgtccttgtcgtggtgtgtaattctaggatttcagtaggtgtctatgagttgcctgtatgttctatcaggtagctgtaacacagcttgttttgtctgtaatagtacaggataagagtatttgcttaatacaagtaacagttgattcatgcttattatctgtgtgtctttctttacattgaataatttttttcctatatgaattacttcatggtctaattcatataaaagtgcatctttccaataaggacaaaattaaagtgtagttcaattttgataacagaattaagtaaagtacttgggggaaaataatgaacccaaacacagcatagttgaatatgctcaaataagtaagattggattttgttccattagaaaggatcattagtgacctgaggacaagatgactaggtcttttgtgatccatgtgaacccaatcctctgtgttatgggcagccattttcttaaattacataaattattatgcctttaatttatatgacatctttcctccaaaggactcaaagtaccttttgagtatattagatcattaatgcttatattgtttcaggggagttgatatgggcagatagtattatctctgtcttactgatggatgggtggagatccagaaaggtggaaggacaggctgggtcacattggagccaccattagagctgaagtcactgagttgactctgtgttccagccttcaattcttaagcttcctactttctcctttcctgaaatctccccatctcctaaagagaaaaaaacataggcaagacatacataattattacttcatcagcttagcagaaaagccaggaaagcactttcctgaaaagggtgaccttttaggaattttactgtatgaaaattgtatcactgttaaacaaaataaaaaagcggctctttgaaaacaaaaaagttctcaacttttccaaactatctggtccaagaggaaacactgaagccccctaaatcctagagcaggactcttgtgtcctagcacatgaagagacttcatcctcagaagattatttgtgtatattctaagtgtctcctgagggccaggttactgctttgtgggaggcactgagaatgcagaagcaaagtcactgcatttagcatccagtctctgattgtcattattttttccccattttgtaaatgaggcagctagaactcagagagttcaaagatcttgcccaattttgcacagatttgtcagtgggaggcctaggactgggggctttgtctttccttctgatatgatgacatttctcatcatagggtaagtctgcctatcaaaacctaggagattattctaattatttgaggttttattgttagaatggagtgctggttttatcttaatcattccctctttccaaatacttgcatctaactggagaccagatattttgacatagatggtagaaagtacacagacacctcaaaaccaataatacctcaaactgaaatatatcgcctccaaatattgcttgttcttttaaattccccttttgactcacagtaccattaatccaggtacctgaacctcctggaactatgactacattttattcatttcacttcctgagtgtctttctgacctctatggtgcctaaaaagactgccaaaccccaacttgccattcatctctcctggaatcccccaataataatatctaacacttgttgatcacccactatagcctgaccctctacctgcattaactcatttaatcctcacaacactctgaggctggttgatgctgttatcaccatttttactgatgaagacttggtatctctttgttatgggccctcccaacatactgatatttttgtggaatgcattttaggaaccatgaacagatggaatggagtctactgtggtattcagagctcttcatgaactggtccaacctatctgtccaccttaatttcccaccacacttctctctggcctctccctcactctttggacttgtgtgttactgttttctcccctgttctctctcttatttttattttttatttttttccttttttgagacagagtctcactcttgtcgcccaggctggagtgcaatggcgctatctcagctcactgcaacctccgcctcccagactcaagcgattctcctgcctcagcctcccactgagtagctggaattacaggcactggtcatcatgccgagctaatttttgtatttttagtagagacaggtttcaccatgttggccagactggtcatgaactcctgacctcaggtgatccacctgcctcagcctcccaaagtgctgggattacaggcatgagccaccgcgcccagccccttgttctctcttcttgaccacagcaactttccggtccaagtttgttcccacctcgaacttttgtacttaatcatctcttcagtctgtcaatttctgctcaaatgccacctctttggtgaggtcttcttattttacctctttctgcatatccttctttgttgttagttttcctccgctgaatgctagctctgcatgcctgtaatcccagctacttgggaggctgaggcaggagaattgcttgaacctgggatgtggaggttgcggtgagctgagatcacgccactgcactccagtctgggcaacaagagcgaaactccgtctcaaaaaaaaaaaaaaaaaaaaaaagatgtgttgcttccctgggcttcagccccctcttttctacaacaaggggaagttgtcacagagtcgtgaggatgaaattgaaggcgccttattggaagatgtcaaatgtcatgtaaatgttagacatgatcattttgttgttaatatcctgtcctatccctcattgccctaggtaggaggcctcccaatgcatttccagtccctgcaacaggtttctggataaggatagtcatccttataccaacgtggcatttggtttggctttgaacttcccagtactccatagatcactttcatcttaatttcccacctccccccagcctgcctgtatattgtttccaggaatcttgattccatctgtcccctgggtttttgaatgccattttcctggcccttcaagctgtatggagagtcatttccgcttccagtctatcactggactcactaattcttgatgtttgccacccgcccccacctttgactgataaattttcattattggttttgcgtgaaagtcttcagggctctactctgcctgacccctgtggtcacttagtgattacatgtgccagctgaggtaatttattcactttgttttggtgtgaacatgtcccatggggcttgtaactgctgtaatcacttgaccctagtgattgttaaatgctttaaacacagttattttaaatttataattgttttcattaaaaatcccttatagtaacttaactgaccttgctgtcaatgtggcgttatgtgcagggggaggaaatgaaaatattatgatgcaaataatatagtactcatcagagatatgtggcaaatcattagctcactccacacattctcacttggagtcctgcaaggaagatgaaagggaagacgacataattatagcactgtccacgtaattcaatgcagccattcccacacgcagggcaggccactagcctagagaggtgaaagtggagtggagcccaaggttaagtcccagaagagcctcgcatcaggcctgttaaatgtgtagacagcacttctcacactggtgggcggcctccattgattaattattttttaattaatatttcttcaagtttcaggaaagttgcaagaataatacaatgaacactcatatacccgtcacacagatttccccaactgttaatgttttgctacatttgctttattattctctttctaggtgtgtgtgtgtgtgtgtgtgtgtgtgtgtgtgtgtatgttttcctgaagcatttgagtttaagtcatagacatcatgcccctttaccctaaatatttcaatgtatctttcctaagaacatggatattcatttacatgagctcactacagttatcaaaatcaagaaatataaattaatacaactgttatgtaatctatagacctttttcatatttttccagttgtcttaatcatgccatttatgacatttttttttctattccaggcttctatacagaatcatgcactgcagtcagttttaaaactcaaaccaaatcaaaacactgtttcttactttgttgccttaaggaataaggatttcttaatggaaacttggtcctatgaaattaggatttggacctacatttctaataatcatgagaattgctgtatattaagtgacaagacaccacactaggtgtgtattttgcaaacacatttatctcattcagcccgcccagcaaacatacaaggaagttattcttgatctgcagctccagatgctgcaactcagagaggtcaccatgctctgggtcacagagctccaaggggcagtatctatgtcccacatcctgcattcttctgcggcatacaagaagggtgggactccaggatcctggagactagtagccacgtggaaacgactgatgttatatttgtttcatttctagtttttacattttactggcaaaggtcagaagatatatttacattagaaagttacctaatatgtattttgacttcaaaagatacggcgtggtgtcctgattaattttaacaattaatgaaatttgtaacaaatgtcaaataaactaggtttgtttaatggaatgctgctagactgctgaccagaaagtgctaaataatgaaatccaaagagccttgataacctggcttgtggtactggacacttggatgttgagatactctgtgtgtttctggcctggctgttagtccttgtggaaacttgaagtcatgttccagagttgtgaattgaatggcccttacaaaggcgtttgattagcaagctttcgtaatttagcctaaatggggctggtggggatgattcagttccagacatatggttacatccctatatttggttttggttttgtttattcttgttttttttctttcctttctgttttattcctaaatccaggatttctgtgaatactggattcacaaaatgaagaatatacaatgaaaatactaaaatatcagttaggtttcctaaatctccccccaaattcataaattacagctaactattctagcattcctcctagtagccccagtactattattactattactagcactaccaccaccatcaccaccacttggagaaggaagtggggatagttgtgcattttcatttaaaaattttcagtatttttccaatatgttatttctggttggggctgctgcttatctgtaaagtgcttttctacaaagtgtaaagaggagtcccctgggcctggtgggtacatactcggtgaatggcagatagctcccacttacccccttggctgctactcttcttgtacagtgaacaacctttgcaaccaaaattaaaagtcatttcttccaacataattattttctggaacatcataaaattctcccctattttttaacgtaaaaagtgacattttgactaaggaaattgataattattttaagaaatgatgtatgttttataggctatttattacaaatgctaaaattaaatgctgtaaatactcccttcatttccaaatacttactgtatatgaaaatgacatataagacaatatcaaaaagtcataggtgacaaataaaaataaatgctagcacaaaacattaaccaaagataggtaataaaaagtgaaaagaaaggcaaacaaaaggaagtcttctgttttgatttgtcccccaaatgaacattctttttgtttgccttattttagcatttatgtagggaaaaaatgacttaattttggttacattgcctgaatttcccagcttttgtcacatccggaatttgtgttaatgccatatttatagtacaccctaaatgaataattaagcagctaactataacatgcattattgatctatcatagatgttattgcagcaagttttgtgtacattatgaaactggggtaaactttttttacattttttacattttttttagctgttcaaattttaagagcaggaaagaagcagcattctttttttctaatttcaggataaacgtgtacaattaaactgtgttgtctcccttctcgctgccgtttttatgaatctcacttatccttctttgtttggaaattaggaggtaaagctccttttggttttgaagagactgtacttgcctgtgagggcagacatctaactataaaatatacaacctctgagctttgatttgtctgtaaaatgttgagaacaatgttaggaagttcttcacttgctgactctaaattaatcctattccctagtcgtttgagactcagtgcccaccaagtcctgtatagttcttccctttattacctcaatttagaattgttaatcaaccaagagcatataataatgttagtggtggtgatggtgatggtagtggtagtaatagtaataatagtactggggttactagtaggaataccagaatagttagctgtaatttaggaatttaggaaacctaactgatattttagtattttcattgtgtattcttcattttgtgaatccattattcatagaaatcctggatttaggaagcaatgtaaccacagagcctgaaaatgtttgtgtatatatagacacatatatatatctccttaacatcattttttatgattttacactcatatatatgtgtatcctagcattcctactggtagctccagtactattattactattactaccactaccaccaccatcagtactattatatgtgtatattttataggctattacaaatgctaaaatcacacccacacatatatatgtgtatatatatgagtgtgtgtatatatatatgcacatacatattcatgtatacacacccacacacacatacttttttgtgtgtgtacgtatatattttgtttgtttgtttgcttttgagacaggatcttgctctgtttcccaggctggagtgcagtggtatgatcaccacttactgtaacctctgcctcttgggctcaagcaattctcccaagtagctgggaccataattttacaccaccatgcctggctaatattttaattttttgtagagatggggatttctctatgttccttaggctggtctcgaactcctggcctcaaatgatcctcccgccccggcctttcaaagtgctagaattaaaggtgtgagccaccatgcctggccctgaatgtgattttatatatgaattccaaaatgaatattttaagcatacacatttaatactatgaaagtgagtaaactaataatttgcctataaaaatagatagaaacaaaaaatgcaaaaccaaaatgtatgtcttttgtaacgcatctggagattttgtcctttgaaaaggccacacaagagttaagggtggtgggaaggcaggaaggacttctatcttcacagtcctgtgcatacgcagctcctagtccagttaaagccttcttatccaacctgacaaggaaagaaaagtgttcagttcatcaaaaaagtcagctaacgtaggaacccatacaaatgataatcatatagctaaatagttttattttaatgtgaagcataagatgtgcatgctttggtcagtgtcctgaggtagaactgaagccttccctttaagtatggacacagtgattataggtcagcactgtctttcttgggtaaatcacacatttaatttctcatctttattaaaaacgtatcacattttcattttggcatatttattggtgaacataaagatgcttgtgaaacaatctgagtgcagaatctttctagaatgctatgatttttaaagtcatttataattacatgagatgattacattaaaaaatacagctggataaactggtttggagataaacagaggtggctctaggacaactgtgcatggagcagaagagcacaggtgactattagagacagcccctggctgctgttagtgggtgcatgttgggcagcagacagtatgtgtctcagagaggctggagactgtcggttaaaagagtgtctagaatatctagaaagatcctaagcagagactgtgtgtggttcttggtagctgttctgtggctcataatctaccataaactcttgtagtagttctcagatctaatgtttgatttctttgcctgcctgggaattgtttttttaaaaatgtcatggatatagttcagtaatagtgtgaatttgttgttcacaagtcagtgtacatggtgagttcctcgtttttaccataagtaaaccaaaatgcatcgcagagtaagaattcatagtataaggtatcagagaggaacttaaattttaagaagggttttatttcttagaaatagtttatacatgattttactaaggtaattatggagactccttctcccatgacagaaggaggaaagatcaagaagcttggcatggcagttctttcttcgtcctttggtagttcttttcatcagggccagaggggttgaagtatgagggtgtccgtgcttacaggacaagctctttcccttctcattagtaccctgttccattgcctaaagagagagaaacatgcaggatgaggaaggacacgtcccagacacataggcctacactttagcagcgttactacgtcttctcgacgtggatagtccagaatttctgaagtgtgattggttcatcaaatatatagtatatagtgttctgtccattcatttgtaaaatataacaaagctcctcaatattgttggtttaaaaaatgtcttttaccgtatacataggcttgaatctaccttgttaaaaattttgtgcttgtgattattagggaaatatgcccagtgttcataaaagtgtttgtgtatgccctggcatggaatatagatatacaccgactaacaatagctataaaaatgaaatcttgcacagagctgtgccctgccttcccagtcagcagtaacaatgcttttggagttgaagggaagcttttccactggggagatatatggggagtatggggggatagcagcttaagaaatggggagggagaagtgctgcaaattttagtataatgcataatgttgaaagaaattctatcccatcataaagattagcaggctgtgtaattcaatttaaaattggttggcgtgtcctgactattataaagcctttcctttttttgttgttgttttatcgccattccattatttgatgtcatataccaatacagaatggagcatacagccaacccatccatacagggtctctttccacatttgcatccattggagaaattgttggggaatgtaagagtttatcttaaaatgaattaagaaaatgcttgctcaattgaatgcctccttgttttctttctttcttctttcttttttttaacacaaaatgaatttcttctgggcaagcaaccattgagagtgaaattcttttaaaagcatttgctggacacaggacttggttctcaaaattccagcattagcacttatctacagtatcatgggcattacagtgccattgaaaatcaagatgcagtagcttatgttaatgcaagactgacagacccacatctgatggcaattacccatactggggggttaataaatgttcttagaattactgtctttattttctttattgcaagaaaaatgggcagcttcctaagccgtgcctcctgcttcttgctaccagccttggtgacttgataattaactgttttcattccagtgcttcatgggctcttctgagtttaatattcatgttagggaaatgctacgtcctttagccaaagtagtaaaaatattaaattaaattcagcaaacatttatccaagtaccctttaagaacaagaaatgaagacgtatagaaataataataataataacgagacttggatgcatcagaagagtgtctggaaaatgaatgcacactgttttttccttctagaagggagcgagcttaatttttattccttttctgaaggggtttcagcacaggtgtggcagagagaattcatcacacttgccagctctgatcaatctaaagtggctccctgaagcactttgttaagaaggatcctcatgctatatccaaactcagtgggaaagatgttatgatttatcagcagtgtctctcatgctatggggtaggggtgtggttactcataccatgcatttgctgtgcctgctatagtgtcattcatctttgttcatattcatgctctatgaatgtggtaggcagaaaattgctgtggtggaaatgtatgcctactttattttaactctttagagtcaatccagactttggaatatctccaatactaagttcctgaaatgattgtgatcttcgcttgatgggattttaaagttttcttcacattaaaggctattctatgtctgtttcaagaggttcttagctgtctgtaaggcaaattgggggtagtgcattagtaaggttgtcaagaagacaagaaaacacatacaacttttggggtcctgtaggatttaggaagcaaattaactttggtttgtgatgctaaatctatagtaagaattaaggttgtacaaccactctgatggtgtggttaacttgtgaagctgttttgcatacctacttggaaaggaattcagagatcaggagagacaattcaattcaatttatcctgttatgtcccccaaatcttgggcagctcagttttctctagcccctagtttctatctcctaagcctgactgcccatcagaatctctcaggcaggtggttaaacattcagattcctggaatctagttcagacttattaaatcaaattctctactgacgagtcctcataattggagctttaatgagctcttccctggttctctcacagccagtgcactaccaccttcttgcttatggataaaatggattgccgggattggggatatattctgcatactcctattatcctaaacccagccattcttttccactctcttttcatgatgacccctgtagacttcatttagctcctctgtaaaagaggataatagatattgcctcataaggttactgtaaagatgaggtaggttaacgtataaaggttttttgtttgtttgttttgagatagagtctcactcttttgcccaggctggagtgcagtggtgcaatctcagctcactgcaacccctgcctcccaaattcaaaggattctcctgcctcagccccctgagtagctggggttacaggtgtgtgccaccatgcctagctaatttttgcagttttagtagagatgagtttcaccacaccaggcttgtcttgaactcctaacctccagtgatctgcccaccatggcctcctgaagttgggattacaggagtgagtcattgcgccagacctaaagttttttaggatggtgcctgacagaggtaaatattggatgtgttggttccaaatctcataattgtcatcatcatttgatttcatttacagggacactgagtatctttgccagaggcagcaaatcaaattataatatcttaccaggctgttgtaagaagcagaaggtatacaaaaagctttgcttggttgaaacactattttttgaatttatgaacatgtaaacatagaacagttaggaggcttttgactgtaagaaacaaaacgctgtaagaaacaaggaatttagtctctcattaaaaaaaaatgtccaggcacaaagcagttttcagcatctggtaattcaggggctcagtgatgataccaggaactcgggttctttcagtattcctcttacatggtggctttgtcccaaaggtttgagaatgactgctgccgaagttccaggtatagcatgaagtaatgacagtgttcattggaaaaacaaggtcattccttccagtatgtctctttgtataggtgatgaccatttccttgaagcccatccacagacttttcttcatgtttcgctggccaggattgggtgaccgcacctccttaaaccagtcattggcaagggaaatagatgtactaactaatcaagataccctcacctgggtctatgaataagtttacctttctggagcacaggcttcccaggggaagatgaatacatgaataaaactgggggctgtgctattgaggaaaggtggggtgaagatttgaatgtgccatcaatagcatctgcttaatgagtctcataatgaagtatctttgcatggcaccttgaggaaagtagcctatggtcttcctagaatggagtcccttgggtatggcaggagacagcactgtagtgaggcttggccagtgactgagataggcttgggtagcattttaaaatatcatgccttgtttccttgtttcaatatcttgtttcctattttcatcctgaaatctttacttttcttgtttcctttttttatgttccttgttctcttttctttcattcttttgtttcctcttttgtccatgttataccaggatccatgtataggacagacttctagccacctgtgtccctttcccatagaaatgatctcagaagagaagattacaggttcctgttatgtggtcagattccaaagttctgagagacttaacctatcatcacctgttatgtttcatggctgtttggagcagtttaaccttctgtcttatccatctacagttgaatagtttacttcctgaagatcacgtatttggcatattgagattctgaagataccataggaactatacttttaacaattcaagctaattatctgtcaccatcaattggccacgaagagatggaaagacacttggttgatatctgagcccactggtagagtgtagcaagaatccctggctagacctcttgaaacaaagatgtgcacagaagacaaggcctgaccaaaaaagagaaagagaaacagtcatctgtattattttaatggttttgagctcatttccctttatagaggaactaggcttaaccatgggtggactgaggactcctgtctctggactagaataaaagtagggcaggaggcccccattatccctccttgctagggtaatgctggtcactgagatcttgtctctcattagagatgcaaagaaaaaatggaagaatatgtttttttttaaggtcatggcccactcagacctagagaacagaatctttcaggataaagcctggaaactgatttacttttttttttttcttttgagacagagtctccctctgttgtcccaaactagagcacagtagagtgcagtggcgtgatcttgggtcagcgcaactctgccccccgattcaagctattcttccacctcagcctcccgagtagctgcgatcacaggtgtacaccaccacatttggctaatttttgtatttttagtagagacgagttttcaccatattgaccaggctggtcttgaactcctgaccttgggtgatcagcccgcctccaccttccaaagtgctgggattataggcgtgagccactgcacccagccatgatttactttttaacttgtacataatttggaagatcaaacgggtttgggaactactggcctaaagtgactatctcaggctttataatcgttaaagggtttgtacaatcccggttctggggcagtgatttttccaagggccctgaggggctagaaatgtggtgttgtggggtaaaactttatccctccctccttccccccacaacaagagcagacctaatttcagtttttttgtttgtttgttttgtaaattcaaacttcttcataaacttttctttgaacaaagttttcccttgaccccacttgccccagcatgcaacgagaaatgatctgtttctgggccaagacacattaggtgccatggcttcctaatgtcattatctgggccatcttggcagagccgagggaaaaatcccatcaaggccactgaatgtctgaggtcacatgaacaagatatggaaagtcaatggtggccaagtagaatgaccctggaaggggaccctggaaccaaggtgcatggccctagtcatgaggacatcttccctctcaggacttctagaagcccaatgacaatagagttctcataggacaccgttactactgcctatttggtgtctcctcagtgaagtcattgtgttgtggcgcatctcaactccccagagtccaattccctataataatgagaatttttaaggagacaaaaatagagcctaagaaaataaagaaatatgctagctttgttgaactattccaaaccacacccagacaataaccacaaggacaacaacagtaattgacgttcagagtatacacacatttagcccaatcttgctaatggattgcattttaatctccgcaaagttgcttcaacattagaccattagtagcttgccttctgaaggtagaaaattaaatattttagaaaatattttcatcacaagggtagatttttaaaaaatattgtctaattaattgtcagctaatcaactatagatgattgcactgagcgttctaatgaaaattgagatttacaaggaactatgtgcttgctatactgttctaaacatctctggggtgtgtgtgtgtgtgcacgtgcacatgtggtgtgcatgcatgcatgtatttcctgccttcttacattgtgccgtacataatcaaggaagtttatttcttagctatctttactgttcgttgaaaaagggctagacagacagaaaatattgacttatccccctcaaagacaccttcctggattgccatatcttggtaattttctctgttactctctttcataggacctgctaattctcttccttgcagttataatctgagttatgttgataggttatttacttctttattatctgttgctcccacctgaatataagttccataaggccagagaccctgttctgtttgctgcattattatattcccagccagccccatcatactgccagtcacatcctaggaccccagggaatatttcttggaggttgtagaaagactgtggtcatttcatggcattctggggccctatttcattatcaaatctcatcctgacttttgagagagtcagaagcttagtgggatttaatggaatctaatgggatttcttttatccaatgctacaggattcgaaaattaggttgagacctgactttgcaagacccttgaaatgagccaaaacataaagaaaagtgagggaagagagagttaaaccacaaagtgggtgaatctgagaatgtggggttgaaagtgaaatgccacatgacagagttaaaaagtaaaaacagtttaacctgaagaactgaaatctggccacactttcctagtaagggatcaactttacaagctttggatgggtttgaatagaagaggttggagttctcagttttggagaattaagttaagccctgcaaaaataccttctttttaaaccagtgtatctaatctccagtttccggtcagaacgctccaaagtaattcaattttaaaaaataaataaaagtagccgttttcagagaaagtcactcttcattttcaccatttaagagtcaatgatctgagccttagcttccactctgaggaaaataatcttagtgaaaaacaaaagctggcatgttagagacatgtagaaatgaaatactaagctagagatgagcctacatattataaaaagataccaatctagaaaatcttttgctctcaaccttgagaaaccaccttggtggtattgatatgaaaaagaggtgctgtattggctgaggataagcaaatgtagccccttagttattgatgaaaataaaagtaaaagttgtgatgttagtatcatggaagaactttaccattgagtttcattaaaggtaactcagtgatagtgtcagagacagaagaaaagcttggaagaacagtagctagacacagaaagataatttctatcatcttaaattactccctggcttaagctcatgtttaagatggctaaatagatgctttccatgagtcaactgaaaaaaaaatggccttaaaccgtgatagtacaggttaaaaacaaaagagtatcttaacaatgaaatttgattagtcctctgtgtctatgaaataagaagaaatgagtgactatatgtcttgggtgttactgcatgatacttgctggtagtggcagatgaatgttaggacccaggattcatgattgtaggcacagtctttagaaaaacttcttagcttctctgaacctaaacattctgatctacaaagtgaatcatttaaatctctgacccggtgattatgtgatatggtggagaaggagaggattggtctgcaaaatcagaagttctgaattgcaactaagtcattgggtgaccttggaggagtcattttagccttgctaggtcttagtttcccattccatggaaggaatgattcaaatctctgaggactctgctaggttggaattttggtaagcctggaattaaaggataaaaggtcaggagcaccctgctgtcccttgattttctgttggaagcaaaaggatagaactggccttgcacataaattagcatggattctttcatctgacccagtgacttgggggcctgagaagatgcacacacgtgtcctgtttgggcctaggcagtaggctcatttataaagagtggcctctgcaaagccagctgtcaaaacagcagtgattttcctgagaggcctaggggtgaaaactttcagatgaagggatacaatgaagaaatacaggcaccttcctcaaataatgaatgactattccattaactccatctattgattactcctctgagctaccgggaacaaaggctggaaaaatctttaagtgcatagtgtcaaccatgcagcaataattcccttctcttttgaaattgtaacattatttgtgtcatgtatatagttcatttattcatttattcatccatttatttgttcactcattcaacaaaattgagcccttactacaggtgggccaacttctttgccctcttttgcctttcccagtaaaaaaagcccctgtataacagattttaaaaatcagatttagtttattaatagcaaattaacagtatactttgtgatgtatataattggtgtcatccttgaataaaataaaaataggacttataacacttaaaggccattttgtagccaaaattgaggtcttcgctaatcatatccacatgattctcaggcaatatagaattatttcttcattcattcatctatttgataagtaatgattgaggccttctgggaatgcaaagatgaatagaatatagttcgaaccctcctgaggtccatagtcatgtggcagaaagagaactcgttagacaaatcctcattctgtgaactgcaagcacttggcaagctcagacctccagatatgagtggggaagtggctggcagggcacagagagttctacacaccataccacagaacgtttggccctttgtctgtgggcaataatagagaatctgggaagatgttaagttgggtgagtgtttaagtgtgtggagggagtgtatatgatcagatttgtattttgatgagatcacccagctttagtgtaggaaggattaagccaaggcagccttctaggaagggtattactttgctagggctgtcaaccatggaaacacagactatgtggtttaaacaacagacatttattttctcacagttgtggaggctactagcaggtttggtctatgcattttgggggaacacaattcagcccataaaagaagcaaaccaaaaagtaggggaaatctgctctttgacagagtgtatgcatatgtatgaggagggagagaaatttacatgttttttaatgaacaatttaaggcaaatgtagtatgcatttacctgacttcacatgtctaggaacaaagaccctcatagaacaaacacattttttaaattttttcattttactgtcatgccaaacacctttttatgtatttatttttgtgtcttgctttggaacaacgttcagcagacagagtatgctctccaactgtgttccgattacctgaattccttaaaatacttaattcaaattatttaaggaagaactttatggaatactttgtgccttaattatactaattaggagaaaacacagatttaggaagacagtgtaaatttatctcttgataaattttaagatgctgaggcctagatctctagaaattggaaaacccatgagtaaggaatgaaaatgtagaaagtaaaatagacctccaattctgcttcttggaaccttgggtaccaagggccatgatggaatttccagaaatcctttcttcctgaggaattatactacgtactttttactgcttcataccagcgggaggcttgtgggataaagccataaaagcattgccaaagaaatatcggagactattggaaatgtgttccagtggaaccaaaacattatccaaaggagacttcatgatttcacaccccccaggaagtcttagtggctctgattcagggtagctcttatagtagtaaatgttgcccattgaggggtggagaaagcagaatggaaaaggaaatgaatatggtctccattccctctatattgtcactgccactattgatcaaaataaccttctctgaggggtttctttgtaaatattgtacttgaaatgcttcactcaaattttgagttataaaatgggaagaatcaattttactggctcctaaattttgctctatgcagcttcctgtccagcgtggatattattaaaattgacataggatgtgtgtgcaaggtaatatcccctttcgtaggcacttctctaaatttcaggatattctgtagagtggattagattatacagtgagtggggattcagaaaggagaatagaactgtgtattgatgccttcagaaatattatttgatggcaataaaatattccccgaaattcccttcagagggaagaaaatggagtttgtttgcagtaattgcattttctagcatttgctcttacactttccaatataagccaattggaacccatgatttggttttgcttattgacaaaagtaccatgtaaattgatctgtgatgcatttaaagaagatgctttgaaagtttggaaattgagatggctttttcttattagattttgagagtattagggttcatttctatattttagtctaatgtaatattagccaaatatgttctttttcaatttagttttaatcaagttctggaagaccattttcatttagccccagtggcgctgttaacgcagagattttatttccactgtcaaccctccattctggtttctgcagccctgccccgcagaattcctgcattcggaaatcctgcatcatctgcccaaatgttatttcagcatgcaaaaatgacagtagttattacaaaaagatttttaaaattcttatttgcaggcttaaggaggggaggaatttaaaaagcctctaaaatggttatttcttttaaaagatatggcctttatgccttatgttatttttatttaatttgatcatcaccatacttaatggtttaaaatgcaaacacacaggatttgcatttgttcctctagttattcagtagaataattgccacttattttataattattgctggaaggaacacctttttctcagttgctttttaaaggctttgtgggggaaaaataaacatatcattcttcatctcatcagagactttgtcagccaacactactagtttattaaagatatttattaaatactcttttaaagaggtagaacataggagatgggctccttattctgatctaagttacactgcaaaacagaagacaggataaaaataacagtaataggccaggcacgatggctcatgcctgtaatcccagcactttgggaggctgaggcgggctgaggggatcagctgaggtcaggagtttgaaaccagcctggccaacattgcgaaaccctgtctctactaaaaatataaaaaattagccgggggtggtggtgggcacatgtagtcccagctacttgggaggctgagatatgagaatcccttgaaccctggaggcggaggttgcagtgaactgaaatcgcgccactgcactctcacccgggtgacagagtgagactccatttcaaaaattaataataataataataacaataataattatcatcctttatgtggcaggtattgtatttggtcctttcctgctctcacttattccccatacccacttcataaggtagattgtacaattattctttttcttttttcctgatgagtattgtgaagctaaaattatgtgtttggagtctgagtttaacaggtaataagtgacagaagcaggaacttgatccgaaatctgtctgactccaaagtccacactctttcctttatgccacatattcctgtaagttcaggttgtataaacatgcacacaactgatccagatgaaacctgacaatgtctttaccaatttttcttgtgattatctggtggaaccttgatttggatgcggttttctaatgcttgaggaagtagattgaagggtctttagaagctagtctgattgttcagatcgaatttgttgtataaatctttctttataagccaagaccctcatttgtaaaggaaagtttggataaaataaacagtggaagagtctaccttatgattcttttgtccagccagatggcaatactggaatataattggagttgcatttaggtggacggttaccactagggattcccatttagaacatgccatgttgatttgggtggcaacttagagatactcggttgggaagcaaggaggatagtgtcattcatttctactaccttgtggttgtcttaaaaatatatataagcgtgaatgagtatgtgcgagtgtgtacgtgtgtgtgtttaggtcacaaaaagttgtgttggaataaggccatggttgaggcaagaatgcttacaaataaggagttgctgagcagcaataaaatctctgggcagttttcgtggtctaaaaattgtggatattaatggcctgcttccccatcatttgcacttgtcagttgttacctgccatcagtgcaatgcagtagtgactactgtaagggatggggagtggacttttgtcttctttgtgtggactaaggtttatcacatctcctggtgccttgggattctctttatggaggaggctgaagcggaggagggagcatttccgctgtggtgtcttacactggtgctcattcctgcagtggaccaccgggctttcactccgcatcccctgccttctcctgggtttctggctcagccctgacattattgtaatatagttttctgtgtttaatatttcttagacctggtttcccattgcaagcatggaagaaaccctaatgcatgagtttcagaggagaaggtagcagtctgaacctgctgtgtggctccatcagcaagtgtgagtattaacgttagagctgtcaggacttgtgaaaattaatggagcctgacgggggacagactgaggtcagagacagagcttgccctgactgaatgtttctggtggttttgtagctgagtcaagtgagtgcaaactgtggagccaagggggatttctggagtatgcagtgggtaccaactaagtgctaagcattcttctaggtgccaggggtacagcagcaaaaagttggctctgcctcctcatagcttatagaaccccctccccacctccaggctggactcaggccttctctgctatcagcccccagtaattgccaaggaaggaatttagatgaaatgtctccttagcccatcctgagcctcatagttcttccatgctcctagcagttggtattacttttttcctttcatcttcctgcagaattttctgcttggccagttttcaagcccaggttattcttattcattcctcagtgaaatagagaggcttcaaaagttttaacattttccctgttcctgctggagttacaatattaaacatataataataattttaaataggaaaaatttcctccttctgtgtgccttgggtgaaacaaagtaactttatatcactggcattagggaacagggttttaaaacaggcatctggcactgccccattgcaggcaggtttcagaaatgtgatcaaattgttgtatatctcttatttagaaacagtcctgtgataacaggtctgactatatatttgtttgattcttttaaatcccaacaagttagcttttttttctagcacattaccaagggaaagtgagcctgaaggctgtgccctgtgaatttgattttcctgggcacctgggagccatagcaagttcttcttctgtcctgtcatctctgttgtttttcctcctgctatagaatgagctttactgactgtgagtgctatgccccagacatttttggtttccttatatattttaaaaatctataatatgggagaatagaggggagagggcatagggattggcagtcttaaaatatgtcagctttatggaactaggttttcttttatacaggaaaatgacaagccatgtttgcttttggaggctctctttcacaaagaactactgctgaatgctggggtttttctcttggttttagcaggagtaaataggagatagtaatcaattagccttgctgaccagatctctgattttaaaaaaaagggtgtggagaaaggatatttggtgttaaccacgacctgatgattgtgatcgaccctgttttccatattccctgttcatggggaatgaagagtatgaggcaagagttgtcttctgaaagttggcaggctgtattagtctgttctcatgctgttactaaagatatacctgagactgggtaatttataaaggagagaggtttaattgactcatagttcagcaaggctgggtaggccttaggaaacttataatcatggcggaaggggaagcctacacgtctttcttcacatggcggcagcaagcagaagtgctgagcaaaaggaggtaaagccccttataaaaccatcaaatctcgtgagaacttactatcatgagaccagcatgaggataaccaccctcatgattcaattacctcccaccagatccttcccacaacacgtggggataacaggagctacaattcaagatgagatttggatggggacacagccaaaccatatcacaggcagattcctgggaaaagtaaatgttctggaattgaccttggattttggtttgacctaaacttgaattttctagaggaattcattctataatgatttatagcagaaaacctgattgcagttgtttgatacttatttttgaggaacattaacttgtattgagggagaggggcaagctagagaggagatcacgtttggccagagcagtgcttatatatgtttattttaaaatgctgatgcacatgtgcccccagtcccctcattgttctctattatcttccacctagttcagctcaattcacattgtttctttacctccctagtccatgtaggtgtttgaatttattacctcagacctccattttcctatcaaaatctcatcctcataattgtagcaacaagtttttagattctgggacctcacataaagttggccttctcttcactgggtaggctcccacattctcctgggagcctgtagataagaaattgtaccaacagctgcagtagcattcggggaatgttttaattaagccaggatgtgttttaattgttacagcatgaggctgacactgctttatttcccatacaggagaagtctgtgatatagccagagaagcatctagaatggagagttctgtttcgtgggtacaaactaaaagggccataaatgcttaatattagataaaaggttactatagatggataatggcatgaggaggattcatgtatgagtaggccttaagtcaaactttatcaagttgtcacatatgtggggtcatctgaaaactactggtctgggagccaaagagctagattctggccccacttgtggcctgtgactgcacttagtaagtggcagcacctctctggcactcagtttcttcatccataaaatggaattgcatgaatcagtggtttcctcttaatttttttaagccagggttaactttcttagaatgatgaaatctttccccagatggtaaaatcaaggaaagcatagctgctctggtgaacctcagagaaggtcgttcccctctgcccttctccatccctggggaggcttcacggagcacagcttcaaaccactagattgtcttggaggacccttaggggttcatgtgttgtgattcatcagagccattataagtggcatgttaaatgtccagagttttataagggagttatgctgactttgacataagttgctatgtgtttgttttaacattgttatagagttcatcagacatgtgcatagctggagatcttaaacttttcatctattccttgctgcatgctcatagaagaataaccccacctgattctaagaagaaattctggatattctgcatgagtagtcactcttgagagaaacagtctggatgctatctattacaggttatactaatcattcatgaatgagaggccactcggcacattttttggtatttgataaatactggaagacagagatatctggatgagagaaggaggcaaaaagttgtgtgttaagggaatacattgtgcgaggttaggattatctcaacagaggtgctgtgtttgcattgtgtgcaggttggagacctcatagccgcactgaccttcacttttagatccaaatgcttattggccctaataatacttttgttagtttgaaagacatgttggaacatgccagtttctgccatgagaaaaatcaaaatgttctttttcgtcttcagatgctttgctttgagagtagtgacattgtgcctggcatcagggagtggtccaatttgtggataaaccaatgatttattgatggcgattgggaaagatggtcatgacaataacataacaacacagctaatgtctgttgagtgaatatagagtgtcagaaactgtgcaggttgtttatatgcaggatgttgtttaatcctcaccatactttagaagcagtattttatttttaccctatttatatctgagaaaactgtagtttaaaaagagttggagattagtcggctagactggatgttggggagaaggaacaggacacttcatgcgggcttaaagttggaagaaaatgtgacattggcttaaaccttaccatagcccaagatgacaacccgagttcctggaattctatggaagttaccaggaagtcttgtggaggttcattcgttccttcacttactcaacaaatctgagttgtgtgtctgccattttgaagatacgggactaggtactttgggtcaataaggaacaacaagccatgatccatgtcttcaagtctatggggatacaagtcacatgcaaaagcaaaactcaaaaatggagtaataatagtgaacgtgcactgatggtttactctgcaccatgcatgtgctttagaggctaaatttcattttatctttgccaaaactcatgaggtaggtgttattatccccattttgctagcacactttagagaacataaggaatctccaaggtcatacagctaacatgtagcagagactacagagtccccattcttatccccatgctgcgtccacagtttaaattgtaatagttttaaaatcgaatcattaggaatagaaatgtgagaagcacagtaagaaactattacatactgcccatagaagtaaagatgaataaggagagtgtcatggaataagcatgcagatgagataggatgcaaaggaagctgaggaagaagagagaggagaggaaatatcagagagggaggaggagaacttggagagtgccacagcagtaatcaagggaatggatcacaccactgtagtgtgatcaacagaggtcagaattcaaataaagccatggctttggccattaggaggttattagtcacattccagggacgcttttggaaggagagtagaagcagaagccagattgcattgagtaatttttgagtaaccatttggctgtacattgttaaatctattaatatagtggcccatcaggcagaacaaatgtggtaagtgggctgtatgagaagaaatcagagaggggagatctcttggcagactggaggtcagttttgcctgatcttttgatttcccacaagaagctggaagtgcagaaacttttgggtgatatttcctgagttctagatgttagttcattacaaaaacaaaacaaaacaaaaaacaaacaaacaaataataacctcagttgagggctaagcatgacacatctgagggctgaattggtcccaccagcagcaagcttatggaatcctcttttaagaagtttagaagtgaaatgaggaagcatctcaaagaagcaaaaaagtcaaggaatgtttacgatcatgtttgaggcacgtatgtgtgtgtgtatgtgtcaagggttgtttgtttttgttttcttggagtgggtaaatataaactcaccaaggaggaggattcaatgtatagagagaggcccaaaatatcaaagagaggagatgcctggaaaaggaaggtgcttatgggagtgggaggaatcagattaagaggccaatttgcaaattgaacatccctactatgagaatccaaaatccaaagtgttccaaaatctgaaacattttgagcactgacatgacactcagtgaaaatgttcattggagcatttcagattttggattttgggatttggaatgttcaatcagtgtaacacaaatattccaaaatctgaaaaaatccaaaatcctaaatgattctggtcacaagcatttcagataaaggatgctcaacctctgttagaaagataagaagatgcaaacagatggtgtgatgggaaagtgaaaaggcagaagtgaagagaacctccctccttctgtacacatgtggttagagggtattttgcatgtctggagaggggctcagttggagcctgggagctagagaggaacctggacaaattttgtgatggctgctttggggaggtagtggctggagtgtggggcacttagaacgtcaagtagcagcgaggaccctgttgactttcagttcatgagtatctacttatgtgacaccactaagtgcagaagatacagaatagataaaactcaaataactgcctcttttatggtctcacttacattctgtagctctaacctgaactgatgagcaagttttccacatctcattaattcacttcctaccattgtcactttattgtccctgtaagttacctctactatttgctcagtaattttcttgaaattacctcttattttacatataaagatagaaaaaaggaagctatatatcattacttatacttttatattgtatttgtccaaacaatgcattcttaaaagtagttttaaaatacaaaactatttgacattttgtcaaaggttcctttccatttcacctaaaataatcttgtgtaccattagtagaacatagaccatgccttgggaacgatgaaactggttggttggtagcgttctttttttttttttttttgagacaagttttgctcttgtcacccaggctggagtacagtggttcaatctcggctcacagcaacctgcacctccggggttcaagcaattctcctgctaccacacccggctaatttttgtatttttagtagagatagggttttatcacattggccaggctggtctcaaactcctgacctcaggtgatctgcctgtcttgacctcccaaagtgctgggattccgggtgtgagccaccgtgcccggctggtagagttctttgggtcattcagagcaaggattttttttccatgttagagtatatatatggccttggttttttttatacaagcaggtcagcttagctggcatgatctgaataaaatggaaaaaggcaggcacctctttgcctgacaattttaaagtgttgctatttgaataccaagaagtttgaagcttgactgcagggccttcccaattaatctagtctggaaaaaaaaaaacaacgaaaatgccgtcaagtaacaggagatttgtcagctgccctgtttacacttttcatataaaacataaaggttggcagattatagatgaaaggtcagttcagcaaaaaagaaaatatgtcagacaatctcataacatcggtaacagaggatagaagttggaagctactactggattctcggaaaaagatgagtttgttggtgatgtgtaaatatcatcaccttttttgtggctcttcattttggtggctacctttttatgctgagtctccaaaatttgatttaaaagacaccaaagatgcttgtctttctgagaaagatttactttgcagcagttttactaaaaagaaagaaagaaagaaagaaaggaaaaacccagtctgaagggggaaaatatacttcctttgccatagtggctagtctcacccacgctgtccctgaacccgagccctaaaacgaggataaattgagaaacccaggcttcctgcaagagcggtggcacataatgaaagggtttacagtgagtcccatcatcgtgaatgattaaaggggaactgggcaactacagtgtgacttgtacaggtaaaatcttctgctctaagaatcacacagtaaggaccggccttggaagacattgctgtctgggaaaacgttttagcctgttccggctttgggagcacaggtgaattggggcggggagcactattagactcatagggtcacagagccatgatattagagttgtagggtctctcacaaatttccagcatgtgcagtactgggaatttgtggccctattgatatatctttcatctgcacttgaagttctggaattgtgcaagataccaccattctatccaaacaacttgctatgtacatcatactcttaattaccaaattcgcataaacatgcatttgagggaggcttcctattcttttttgaactcttcagcatagccttacaaataactgaggccaaagacgtgacatacagcactgtgggctagtagtcaaagatatccattgctgcttggcctcagcgtttctggtttcctctctctgcagtgttattttctatcagactgctttcatctctctcttaagcctccccattattgcccttgctatatatgcaattttattattgtcagaaatctaacaattaataactaaagaaaaggcagtaatatacaaaacatggtttggcagtcttaaaaactgcttcaatattagcaaatatgtttgtgatgtgctgctgagactgtgtggacttcacaatgtaatctttacagtttgaattgctgaaatccaagtggactgacgatggaacttgctcccctcacctccccccaccccccgcccacaaaattctcttccccactaagtttccttaatgaaatcattgagactctggcttgctggtaaggaccagttcttacaacaagtgtatccaatttcctgctagtggtaactttaattcttcctggaatagcaggaaacattaatttcacatcagacccataggtctcagaaagctggaattataggtgccattgtcccactctttttttcctccaaaataaaataaaataaaaagcagcagatgaacagtgaggcttgagggatgggtagtgacagagtaaggaaaagaacattaatttcaggtggggacagctgcccggcactatctccctttggattttcgttcttatagcatcacggtgagttattaatatgtatgacccgtactttattcaaacattataaatctatgcagaagtctggtgtttgggttttcctttatagctttcattcttcttcccagaattatctcattttgatcaggaaacttttgcataaaaagcacacactgagaactcacatttccataccataaatattaaaagagggttaaactttacagtttcttctcccatcccaataggaggaaagttagccttctaatcagggggcccttactaatgttctttttattcacaacccaaaaaggaaacttaaaattagagttgaaatatgaaattatactatctggttcctttaatgtatgtcaattatggaatgtttgactatgccatgtctttagtatgaagcatatactaaaaatctagtagttatctaagttgttaagaatagttggttagattatgttttgaggaccaaactaggtacagaccttctcttaaggatcgtgattaaagagctttttactggataaatataaagtgtggattcattaccctgtggattcatcacaatgaatacatagcatacagaagagggaaatggaactagaaaacttaatgtctttttagcaacgttttagctacttagcagcttcctatttcccgttattgtcatttttgttagcataaagtagtagtcataaattccagttcacatggaaatgtaaaggaatttgcgagctatttcatttgggtgagctgtctgctaatcacacagtctcggctgttgtactttgtgatgggaaatgaacgtgctaattggtgctcttttttcttatttcaggaaacctgccatatgaatataaaatagtgattgctgggaatcatgaactgacatttgataaggaattcatggcagaccttgttaaacaggactactaccgtttcccctctgtgtccaaattgaaaccagaggactttgacaatgttcagtccctcctgacaaacagtatttacttacaagattcggaggtaacagtgaagggattcaggatatacggtgcaccttggtaagtgatgattcaaacagttttccacattgctttttagctcagtaccaagaaaacacagctcagatttagatgctttaaatgaaaatgattaggatgaaaggaaaccttattgctgtatttccaacaaaatacatactgtactgctgcaaaatgcaacacttgttgttttcattgtgatagagatccctttaggcaagatcaataggagttaaagctttcctagatatatacagtcatgcctccctcagtgtccatggggtattggtccaggacctcccactgataaaattccatcatgctcaagtcttttatataaaatggtgtagtatttgcatataacctatgcacatcctcgtgaagactttaaatcatctctagattacttataatacataatacaatgtaaatatgatataaatcattgttatgttttatggtttaaggattaatgacaaaaaatatccaacatagaggcaatcctttttccaatattttcttttcttttcttctcttttctttctttctttctttctttttttttttttttttttttttgaggtggagtatctctctgttgcccaggctggaatgcagtggtgtgatctcagctcactgcaacctccgcctcctgggttcgagcaattctcctgcctcagcctccaaagtacctgggattacaggcacatgccactgtacccggctaattttcatatttttagtagagacggggtttcaccatgttggccaggctggtcttgaactcctgacctcaggtgattggcccgccttggcctcccaaagtgctgggattacaggtataagccaccgctcctggccctttttctaatattttctatccttggttggttaaatccctggatgcggaacctctgattatggagggctggctgtatatgtttatgttactggggctgggtgtatgtctgtgtgacacagaaggatttgagaggaggtcaccatgctacccttcacatagattcagctgctctgaacattccatcagccttaggtaactcatttccctctcattttgtactggaagcagtcataaaatatcttgcttagattagggtttctcaaacctccctacacatcagaattaccgtctctgtagaaatatagattttgaagcccttcctccagagactctgattgtccttcctgagatgaagcccagcagtttgtattttttaaagttacctgggcaagactgatgcacaggtggtttgaaagttactggttgagagctggcactagaattctcagaactaagctctggaaaacttgaaacaggtacatgtatccttggaggccagacaagaagcgtgtcaatcttgattgtatcagttgacagttgtcaggttttaaaggagttacttcacagtgtctgagcctcagttttcacatctctaagatggtgaagatgatacctattttagagggttatgataaggataaaataggtaaagtttgcagtggactgaagagaatatcggatagtttgcttagggtatgaattataatttttctggccttgggctctcccactaagtatttatgtgaacttaggcaagtcatttaggccctagagccagtttttttttttatctttaaaatgagaatgttagactaaatgattgtcaatatcagcaggttctaggactttttttttttttgagggtgtatatagagcaaaactaacctgtgtgtgtgtatgtagagcagaagaactcacctttactcacttaatacagaaaagtaccccagtccttcactaggagttgtggataggactggaaaaagacaagcagactgaattcagattggtcactttactcaacagtttggcttgtcctctgtaagttaaaaggttgagatattttctttttttttttttttttgagacggagtctcgttctgtcgcccaggcgggagtgctgtggcgcgatctccgctcactgcaagctccgccttccgggttcacgccattctcctgcctcagcctcccgagtagctgggactacaggcgcccgccactgcgcccggctaattttttgtatttttagtagagacggggtttcaccgtggtctcgatctcctgacctcgtgatccgcccgcctcggcctcccaaagtgcgagatattttctataattttttttctagctttacgagttggtatccagaaggactggtgagtgggtacaggaagtacatatctgtttaaaatcaaccccgacaatgattttgaactcttaattaagtacttcctatatgccaggcattgtcctacattttttgtatacgtgtcatcttatttaatcctcaaaatacctttaggagatgggcactattatgattctcatttggcagataagaaaatccaggtgcagaaaagttaagtaattgctcaagaatcgccacagataataagaggtctgatttgaacctgacaagtctgattccagggtgtacagcatgactgaggggtggcaggggttgggatgtggtaattggtggttataatcctcagatccagtttatacctagctttatttagtaaggtacgtcaatttatttttttaatgtgtgagaacgtggtaaagggcaagagaataaacagcagaaatcagtcctgtcaaactgtaatctggggtcatgtaggatgttgatattagcatttctgggtaaagggcaggagacagagcatttccagcttcacagcccagttcttaatgtcagtacagtagttgaggaatgacctctgattggcagaggtgctctacatgcaagttaagatcattgtttaaaaataatttaagattacttttgaaaaaatccttaaaaggcacaggacatttaaggctattcctgagcaagcagatgttcagaaatccctggactgatagttgctgaaatgatgacagcaacaaacttcctccattatctgagctgattcaaatctgtttaggacagggttcagctaaactagattgtagctgtgatgaatgagggaatgattttggtcctcaggcagatcttgcagcatctcaagcaatcgaacaaacagactaattcagatatgtgatgtggcagggcatgatctgtttttggtggtgctgcaaactgcagacaaagtttatatctgaactggattgatatcatttaaaatgttttaattttaatactggcaaggtagcaaagtcaagaaaataagcactaatcagtcttctgaaatgttctcctaaaggtgtccttagacttaagtctgttgagatttccacaaagcttcaaccatttcctattgagcatctctttacaatgagggagatctttaaatgatttttgccccatccattggaattgttgatactttgtattttgaccaagaatacagaggttgacaaaaatgatatttcagtttcatcatctgtttttgggaggcatcagtagtttggatctcactgtgaagatatttcatcaaaattaatattcccagagctactgataatctgaacatcgatttagaaatgtctgcattagcatttctgtgctagggaggagagtatttgccatctttaccacttgctcagtgggaccttgggtgagtttcttaacatctgcctgcctctgtttcatctctaaaatgggagaaaacattacggtttcatggttgttatgaagatagaattaatgcatccacagtgcatagaagactttttagcatggagtaagcatttgataaatgttagctattactactaatagtgatgtgttaatgtttccaaactactttatacctctgtcaaccttcataaggagactatgggactaggagtgagattagataagttttagccctagttcaccttctgcccattgggtgacactaggcaagtcccttaacttcttcatttagttgtaaaacatgaggaatgaggtctgcccttgtttctctcatatgccacccacttaaatggtcatcaaagttagaattttcaaaaacaatacatatttgtgagcatgcttgaattcctttaatgtcttgtacaatttttaacctcttttattattaagaagcaacgtttgggagaacttataccataggtaccacttttctcccctcggaaattagattttttccatctctgagatttacacataggtgagtccctgcttagtaacccaacagatatttcaacccaaaataatgtaaattgattgtttgatttccctgttttcacagtgacttttttggaggaagtattaagttctgcattgctgataccgctagtggttttaaaaatagaaatcaaaataagaaccctgatattaaggattcacaggtttctcaaaagtaatcgccatcagactaggaaaatagctataattcatgtatttagaagatatggattgtggcttggtctagctacagaaaaagaatattagtctgtatttgttacatgttgataacttgcaacacagctgaaagctacctcaagactagggagaattaaagtagtgttttctaatttacagtttaacaggaattggtatgtagaaaataacttacaacacaccagagcatttatatatgtttgcaaccgtaatgttctgtagtacttactagatccccaaggaagaggctttgaatgtggtttgataggtctgggaaaatccagtggcctaaactgaagatgttataagtgggatgccaggtctggaaggaaaggggctccctcaaatgggaaggcaatagttgatgaattctttaggggcacccttacctcaggaggccttaaggcaggttttatggcatctgtatgtattccttcaccatctcattcttccaagaatctggaagaaaggcatcaggcatctttttaacagttcagccacagatttgcttcacttctcctattgttgtttttttctcattcttttttgggagtgcagaagaagaaggttttttgttgtcaggcaggtgggtcagcctcatacatacttcgtaccatgggagagcttgtggattgcttgcatacctaaaattgattctctgccaccagtggtgcccaattttgtctttgtgactcactctcagctctgtaacatctttctcaaaggctgagtatggttagaaagggaacaaaattctaatctgtcaaatactagcccctgtggtaactaatggcatgtctggctgggtagaggtaaggtagagttttgaaatcatctttgtatttttgattactgaatctgtagccagctttttaacacaagcaatttggggtaaacttactcgtgggactaggctcttcttttgctgttttgatactaagatactgtgcagaaaaaaaaaaaatccacatactaattgatcagcagccaagctgcagaaagtgaaaggtctatattgcaccgactggagcagagcagttgtattgttcagcgaaagcctgcaccttgttcttctcttgaacagaaatacagagctggtctcccgtggcttttaatgaatatgagtggggctttccaatgtccaggaatttgatctctaggctgaccaaagggtcaggaacaaagaacacattttttcacgttagagtggacccaggtgtaatttgtcagatttagtaactgtggaggaagtgccttaacttctccagcaggaaaattagatcaggcctaggcagtgcaattctaaaatggctgaaataggaagagaaagtctgttgagttgcattttcaaaggaagtgtgagcaggatttgttttcccttcctctcttcccctcatttcctatcataaccatgttgaattcattcattcatttagatgtaattttctcagcatttttcaaagtgggagttgatttcactctctgcagcatttctaattgtgtttgcacacaaatagctacaaggttgctcacatttcccttgttctgatcagtgcaatagtactttatgtttactctgtcaggaaagcgtcagatgtttttatttccaattataagttttgtaatgcatcatgtattttgctgacagtcttcaagttcttgaaatagtgaacaaattaacagcagatattgagtgagaggattagaaaaccaactggcaactcatatgatagaattcagatacagggatgggtggaatgggctcatttattttattttctcagtcatactttgtaattaacttaggcaaaaaaaaaaaaaaggagaagaagaagaagaaaaaagaaaagaaagaaacagctccttgttcagcagaaaaatcctttggcactaaagaatgagactatgcaaacaatattggttctgtacgacgttttcagggatttcagcttttattcaggagggttcagaaaggtgttggcacagaaaaaggtcttgtgtgtgtgtgtgtgtgttaaacaaatatgcactctgctcttacatgattctgtttaaaggcccagggtaacatttcatttttcttggcacagggcccatagactctcccattatgaaacctatggctgttctgccctagtctagagttacagggctctgtttacatttttgcctgtttcagaatgcagctgactgctcttaaagcccggatcagattcacttctggtttaacaactgccctgtttatttgaaaaaggagaaagcaaaaccgatcactttgcttcctacctcgccattgatgaccaaatcagtaaataccatttccaaagccagtttatgcagaactggtcatgtgggatctcactcgtccctttctgccagctctgtccaattcagccttcaaagcctgccgggtgcctttatctgatgtgttggtggtggttgtatggaagaatgtggaggtgctaaagaagtatttgtctgcattcaattatgcttcatagcaaccgttggcataatttatatttttgcctgcacattctgagagagccatttggcaaacaacaataataaatttacatttggatggtgtatttcactcagagaactttcatatgtattatctcatttggggctcacaacaattctttaaccagggtatgtattactaataataattaacaatagccagcatttacagtgtttatatgtcaactgctgttcattattgcctccttttgacagagaccaacatagagagtttttgacagagaaagtgacttgcccaaagctacagacttaatttgagggcaaaataggactagaatccaggcttcctttgcggagtttgctagactaaaccaggatatcctagatgtctgtctactccgtggcctgagcaactcaggaagtagctgcttttcatcttagaagacctggacgttttcatctagttgcaaaaagggtgtacagaaatccaggccagcacccttcaggggctctcaggattaagtggtgaggtgtgcttctaggggaaaataggatcattgagggaagagaaaaaacaagtgactcagacactagggtttaaaaagaaaaattggccaggtgcagtgacttgtgcatgtaatcccaacactttgggaggttgaggttggaggatcacttgagctcaggagtttgagaccagacagggcaacatagtgaggccccatctctacaaaattaaaaaattagccaggcatggtatgtgcttgtagtcccagctacttgggaggttgaggcaggaggattgctgagtctgggaggtcgatgttgcaatgagccgtgagcacacccctgcactcagcctgggtgacagagggaaaccctgtctctcacacacacagatttatgtcttaatgtgttataaggcatgagtcagctcctgctgttcctgcaccacagaggcaacttcctccacaacacatatcaggaggcaagtataggttgcatgtggctttttccctctgaagaaccatgcagtggagagagacagcagccctgggcatatgcaccaagagggaagtgctggcagtgtacttcggctgcagtcagacctgccatgggcccacactgtgctccacagaagacctggacctccactttgggacatggctggctggctgctgggtgttctttcattttctcctattacactaataggctccttttaatccagagttgctgctggtggatagaaagagagtataaagtgattacaagctccatcagagcaaggacctgtactttgtcctctatgcataccctaggcaagctcagtgcctggcacatagtagatgcttggtccctgtcttctgaacgaatgaatgagtgaatcagggtggtggtggtagagatatgtctctggctggtgaactgagaatttacacagattagacacccagtgacaaaaggaaagaaagtatttccaatacaagatcaggcacagtcatggacatacaaaacggaaagactagagatgatagagcaaaatggaaccaagcaaagccctaaatgatgtccatgggctttaataacatgtgttaacaaggtacatgtacctagattcttcctgaacactcagaaatctagcatctcttcaggtgagcatcgttcaataaaagtgagaaatgggagtaggacaaatcttacattaaacctcacagtacggcagtgagagttttcaaagaaagcctccaccagcaattttaggctttttggtatcatttcttcagctcagacaccttattcccgtactgtgagcagctctagaaatcactcttagttacagagaccgtcgcttcaaggctgcagtcaaagtagttggtgtcaagtttgagattggtcggaagctagaccaggtgggccctcagaacgtcctatggacattaaaaccaattgtcaaatatacagtattcccttttctcagtggctgaattctcagtgattgagttcttagcgtcgtgtagattctgtaccagttatattcaggctacttgacaaacactgattacttattttgtactctgaactgtaagtgaagagtgaacttctccaggtcttgccagacagtgagcccactagagtcccattgacagtcttaacctgtatttatttggttccagccttagctgcttctgtcttcctgtgatgcatttctcctctgtggctcagatgtgttcacaagttagtttaggtaaccacactggatactttcatccttctcctaatctctgatgaaggtgagatgggttttggagcacacatatatttggagagatgaggttgctccttccactgggtgctcctcttttgccagcaccacatctgcagagccgcaggacatccttccgccccttctgatgagcctgcatgctgccaaagttgtttcacaataaagccttaataatcagagccatgttgtgttatgtgcttcatacaggagaagccccctgccttctaggctgttttgtgagagcaatgtcaaggcatgatgtcacccaccctctcaagggttcatctataagcccatgggaggcttggtcgggcttgtagagccaccatgtgcctagggacatcccctctgatggcgaaggctttgttgaaactgttctccaaaaaaattattgctaattctctcttcccttaaacaagcagttccttaggctacaaaacttctggcagggcctccccagcaggaaggcatgtgctccccacattgggcatagctcaaacatctacaactctgttttacttacagaaggagggaggcagtggtatagagctccgcggggtttggccttagaaacaggctgttcccaataagcttggctctcactttgattatttagaacttatttaccttgttacacatgttatgtgtaacatgtgtaaatgttacacatgttatttaccttgttacacatgttatgcaatctctctgaaccagtttcatctgtcaaatgtgtatataagtaataataataactactatttattgagcatcattcacatacaggtaccagacgtaaaattgttttaaagcctcaaagcaaccctataaaggagataaatattaccctcatttgggagatgagaaaattaaaggttagagaagttaaataattcactcaaggacacttattttgcaaagaactgtaaatcagtcccaaatcggtttgcttccaaagcctttatgttcttcactacttctgtatatttttcatgggattaaaataagatcatgtatgttaagttcctggcactcggtgaatgctcaattaatattatttttttccccgaaaggtaacagttgttagttttgtaatggctattattttttggttttgttttgtttgcttcgtttctatggtggtattaccatggtagaagagaagaagcaaaaaagagtagaaatgagataaataggaaacttagtctaggaaaatgcttacccctgtttgtgtattggtgggggaagggggataaaggaagagagaaactgtttaaagtgaatattgtacagtttctttgcatggcaggttgcttatgatctggatacgtagaaaccatttaagaaaggaaccccatattccgctgcatttggtcaaaaggcatggaagagtggatagacgtctgttaaatgaagacatatgggcattttgaaggtcacttacatggagtatcattttcagtgtatgagtaatgttggcagtgtgtttccacccaggaaaaataaaagtaatcttggatggtgactataaattaaatgtggactgttccatgagggctgctccaacaccaagtgagtgtcaaactttgaagtttctgggtttagcagaatgcatatgcattctgcaaagagctgcaaaggtgagctacaaatctgcattaattcaggagaggatatgggaagactgttttgcttaaatataaaaaatcagcttggttaaagtgtaaatacagttactataactaataatgtccaagtataaaatttgtagcaagaaaagaaataaacaggcaatgagaagtacctggtatagaagggcatactagaagaagtggttaagacctagcttaaataatagtcttcctaggatgaaatttcctaagacagcatctgaaggtgccagtgatatttaatgattaatttagatattttcaggcccaatgtcttggtgtggtgggtttacaggatggatcacattaaataaaaaatggtgctaaaatttcatgtaaatcaacattgaagactaagtgaaaccaatgctatatttgtaaaggaaagaaaaagaagagcagagtcaacatattgatttttcattctttcctaaacttggtaatgaacttcttttatacattatgtacaaaatgattgcatatagaactacgtgcctctgatggctgcctggtttaataaactgtgattattgtttttctctctacatttcaagctaccatatgtactgaatttctgggatatatcaatctcaaagctaaacctaataggatatactgactttccatgccacacaaggcttcatgagccatgggaagtagctttggagcgccatggttctagaaagaggattgtcaaagacagacactcaggaaaaaaaaatgttttattgtcttaatgatttaaaagttcaactcttaaatcactagccataattcaggcctcttattgagtcagtcatcagtagaaaaacctttcttgctttgatctttgaagaacaaaataaaagatgctagactaaaacctaatcagaaattattgatggcaaaactaactagttggaataggctattggcagaagtctctctcccacttttcttcttttcctttggtgttatgatttaaggggaaaaattatggaagacaagtttgttttaaaaactcatagggttcatttgtgggttttgcatttgtatatatatatttttaaataataataagaaagcacttgagaatgaggattttagcctatgctgatgctactgcttctgttgctaaacattacttaatgcttcctgtttttcagaagaaatagccaagactagttccttttcttatccacattcagccatttcccttaaaaagataagttctgaaaaaagtacttacctgttgggcagtagaataagtagaaaaatggaaaacccaaatgtgtgtgtacaatgctgggtctgacctttacgcttttaaataattcttaccggaggcaaattctgtgtggttgccggctttcatagcagcttcagaggcaggcccatgagagacgagcgaattttcagggtattgagtgccttgctacattcacactgtatgtgccgttcaagattactattgaagggaaaatcacaaggtattggtttttaaggagggtattcgtatttaaggctatttgctgtaggaattaccttctacagagtttgaactctgttctgaaaagtctgagagaaatagaaacagttcataggaaattttgaagtttggctagcctgtaaaccacaggcttaacagtgctctaaagtcagttctgagactttgtaactcttgatacataattatgaatgcatttttgctttgttgattgttccaataaacagaatcagtggattattggttaagcagaatacaaatatgccagagaaaattcattctctttgtctcactctgaaaatattgcatcaaataatctgaacgagaccaaaaaagctttttgtctgagtttctacaagtaacagtagaaaaaacaatgaaagggaaatagttaaatatagaaaatcatcaaaaatagaaatcatgcaaaaagtagacatctcgattcttaaaaattatgtttcccaagctgtgcaaactttcctcagttaaccacatactcacatgaatgaagatttcacaattccagtaaaagcattcttacattcaccttgaatggttttgtcccttgaagaactagcatcagtcatcagacagcaatagtatgtttttcttcttatatttagcagtaagcattttaaaagccatatcctcaccaaaaatgtacagatggatcattgcattataaaaacatatactaatatagtcagaaaacaaaaactgaaagataatacaccacaagttataacagcgattttctcttatgaatgttctttttttctttctcttattctgcttttcctgggattttgtacattcttacagtgggtaagttttatttttacagtcaggaagaaaggccacattctgtagccgtaaaatgtgtgtctatgagtaattggaaattaaccctgtccttcaaacttggtgccgtcatcacgtatatgatccgggtgtgtgtgtgggttggcacatatgtacatatttcacagattatcccattcaaagatgggaaggtggaagtgtctgtcctcaacaagtactgtggtttgcctggctgaaatgcaaggaaacccccaaaagcaccagagccctgcatttattcagctgaaaaaatgtgttttcttttttaaatcagagtctcctaagatagaagaacttagatggctcatccagtgctgggttgaatgataaaacccagacctttttggtgctgcgttttgattcatccctgaatgtgacaccctggtacttgggttcctgggtctggctttacaggatgtgacttcagtcaaggaaagcctggtgcctacctttgcttatttgtattctagtgctgtaagctcccctcctctcatgtgtctttgttctattaatctgcaaaacagggctcgacttgtgattagtccttggagcttgtttctattaatcagtctgcaaaacaggtcgacttggatgcttttgttcaagagcttaatgtgttctccttgtcaggctgtggttcaggctgctcggtttgctttaaacgggaccagatggtgaaatttggtttttatacgctgattgcactgtcaagaaggaaaatactgtttgaaaagacaacaggaaaatgctagtgtggagttgtagagtgatgtttcaggaggaggaaaagtttatggaaaatataacttatgtaacctggctgtggtgtataataaactgcacggtgcagttgactggaacagaaaataaggcattattcatattatagtctagaagcatggtgtcaaggaaaggtcgcctattaataaaattttatgtggatttgaaatgtaattcttttgattcttaaagtgggaatatcattcttttagctacagtattagctactgtaagaagacccaatacaattttgtgcatttcctcactttttcctttccaccctcccttgtgccaaatgaccttgccacagattaaaattattctacctgttatgtagggaaaactctgtatctcaattttcttatcttcattatcaagggacaaaaactgacctacctgtggagatagagtgtgggctaactgagtgatagttataaattgctttgtaaaatgctcattatcaccatttaaaaaattctcctaactctaatgtgcaaaggatagcgtcactggaaaggaattgaaatgcataacttttttctagtgatagcgacactctaggaagaacacagtttttattggaagttgtcttttacatctctaaaaatttcaagtaaatttagcattcattacttgtgaaatagctgccccctccaaaaaatctgttgaagtatatgcaaggagcaaagtctcaaaactccaaattaaatttgtcatcagtgataaatttagtcctgtgagatagtttaataagtgcttcagcttgatttattggctttgttagttaacaagagtgtattatgtcttgtacagaacttagcagagcaatttctgactagaccttccttgattaaaataaaaaactgaaagtctcattttagtcacggcgatggtaattattttaacatgaaattggaaggtaagcacactgcagtcctgtcattaatatttaaaaaaaagaaagaaaagaaaatgtcagaatgtgaagggaaaggcatttaaaaggttctagttctttatgtttgtacgtactttatttcttttgtgtgtatgcagagcgtctaggctgtttcactggttggggctgaagatgcagcccttgcatatataatcactaatgagtgtcaggattcagctgctaatttgaaaggctttgtggctctttcaccccaaacacgagaagcttcattaggcgctgttttgtccagcctgacctttgctgatctctagatcacagctaaacaccaacattacaccaacaccctcccagttgaaacagtccagacatgattcctttggtgcatatcttatcagaatctgctactgacataaacttgggtgtccctgtagcttgccacataattaggattaccttcccccaaagaggccctatttacttacaattgtgttcagttgattggagatttgaatttgagagcaattagcaaatttctcagtctctctctcttttttttattttctaaaaaaggcacttttataaggcatagcttttaaaatatgttcttatggctgtttcagtgtaagcaacagacagctactaataaggtatttctctctttgacttaggaaaaatacataaaatttattattagtgatatcagattttaaaaatggaaagaaaatcaaatggtatttttttttcctttagaggtatgtctttgggagtacactatcctcaaaatcaaaccttgtagcaagcaggtggaagagacttttctgcttacactattttaaatatcctgagcaatgaaacaacaggcatgatttatttgtcaagcttttggttgctggggagggaagccttacttttcagtgttattgtttgtagattctccccctactcttctcaattgctagagattattctgctttagtttaaaattttactgtatatttgatatgaagcagtagctaagtggagatatcttttgacattatatgtaattatcaaccagaaaaatgcatctttataaacttatttttcaacagatccagtcatctacgtcaggtctccggtgaccttattttgaagtggtttgaattctctttcctttttagagtcataaaattagagatgggaaagagctctctgattgcatcactttttccacccttttggccagtgtgatctccctccctccagcatattccctggtgttccattcagcctagtttaggataagaagaccagggaggcttcttgtccaggccctctgggaaaatgtcccacggcccttgacatgtggataagcttttaggcatgcaagctgaagttttctcctgctttgagactgcttcaatattcttgagttcaatgtcttttcttgttgttcctttcttctaaagcatcaagaacttttttctctgtcaaacagcctgctcatattgtgaacagcaacaaaaaacccacaacactacacacaggcatggttttcctccttcttccgttcaaaacgacaacgttatttaaggtgtttcgttgttattaaccacgtgtctaagacatgcctaaatttgaatggttcataaattttacctataaatgaatctcataaatccttagccatttcatagaccctgtgactacagcgtctcagaatcttgttggtttagagccttttcaggagtccaggaacaagatggggatactgacaacatttgtttttagatggatagaagtaaattaatcaaaatcctttgtttatgatgcattgccatcattggtctgtgcctagcctttgttatcatcatgttatttttccatttatgagtaatgtagtgaacatccattaacccacagagagcctgattactagaacattgacaataatttgtgtttatctatgtgctttctcgtttcttatctcctgccttctttttccaggtatacattaatctgaattttgtttttttcattcttttgcttatttagatgcttcttataatacacacatctaaacaatatatagttattggtttcgaacttaatacaaaagttactgtgggtttctcttttagttatggaggaataagctcctaacaaactaagtctcctgcaaataactataaataacaaataaaataactacccaagggctttggaggtgcacagaagcaagtaggtttttggaggggagttgaaacttagaggaagcaactccaatgaagtttttcatttctgttggtttctggagggtagccacagtttagtaaaacggtttcatgatatggctaaaattctgacagacagcccatactcttttgggcaggagaaaccatttgaaaacgctcagagtaaccagagccaccacagagtgagggggaatcctaggggaaaaaaagagagagctaaataagagaaacaccaaattctttgtgtatattctacaaagtctctggaccctgagtcatgcatgtaggggcagattgaaagtgtctaaactgagatccgagctaccgtccaccgtagatatcaacatttaaacattcaaagaagaagtaatgaaatcttacagaaaatctttccgaaatttgaagacgaaatgcttcccaacatgttttatagccagcatgacattaataccaaaacctaacaaaaatgtgttaccaaaaaaattacagaataacatgcctcatgagcagaaactaaaatactttccggaaggttagcaaatcaaatccaacaacatatagaaaggttaatagattatgatcaatgtggatttataccaggaatacaagatgggtgtaaagtgaaaaaaaaatctatctaattcatcctattaacaggataaaagaggaaaactatgtgaccattttaatagatacagaaaaagcattcaaaaagactcaatattattcataataaaaactttcagcaaccaggagtagaaagcttcatcagtttaataaaagactacagtcctacacttaacatcacaactgatggcaaatattgaatgctttcacactaagatcagaaacaagataaggattcttggattgatactgctatttaccattgttatgaaggtcctccatggtgtaataaacacacacacacacaaaagaaataaaaggagtgaagattggagacaaagaagtaaaattgtccatttctgcagatgacagggttgtcattgtagaaaattctaaggaatttacaaaacaactgctagaagtaataagtgaataagaatgaggttatgggatgcaggattaagatacaaaaaccaattgtatgttttcataattgcagcataaaatttaaaatgaattttttaaaatgttaattacagtagcaccaaaaccttaaaatatttaggagcaaatataacaaaagatatgtagaatctcttcactgaaaaaccaaacaacattgctgaaaaaattaaagaagacctaaacaaatgaagatatattatgtttgcgaactgctcagttctccctaaattgatctgtagattcagctcaatctactgattgggtaaaaatctcagcaggcttttgggctttgaaaataaacaagctgattgtaatattttttgaaaataaaaaaagatttcgaatagtcaaagtgagtataaaaaaataaaagttgatggactgtactatctgatttcaggcttactatgaagctttgattattcaaaacaaagtaatatgaaaggtggacacatagatcaatgtcaaagaaaagtaaatccagaaacagacccatatatatacagccaaatgaatttggcacagtttcaaggcaatttaatgaggaaacagtagtcttcgataaatggtacctggacagataaatatcaatatggaaaaccgtgacctttacctcataccacatacaaaaataattacaaaacagatcttacacttaaatttttttaaaaaatgaaatctataaaacttctagaagaaaacttaatctttgcaaccttggaatgggcaaaatttcttagattcggacacaaaaaacataaacaacataaaccactgaagaaaataatgacaaaattttaaaattttcagtctttgaaagatatcattacaaaaatcaaaatgtggtccatagtcttggggaacatagtctaggggaacatattttcaacctataaatctggatattatgtaaatctctatccagaatacataaaggagtcttacaacccactaataaaaaagacaaacaccccaataaaaaatgctcagaagtttgaattgactcttcataaagggatatatccaaatggccaacaagtatatgaaaagatgttaaaaaacattagtcatggctgaaatgcaaattaaaaccatagcaagataccactgcacacacaatagaatggctaaaatttaaaaagctaacaataccaagaatgacaaatatatggatccacagatagaggcagatatgaatgtaaaatggaacaccctctttggaaaactttttggcagtttcttaaaaagtcaacccacatctactgtacaacctagccattctgctcctagatatgtactcaagacaaataaaaatgtatgtccacataaagacttgtacacaaatattcttaatagctttattcacaataaccaacaccaggaaacaacctgtacattggaatactactcagcaaataaaaggaatgaactatactaaaacatgggataacatgaatgaatttgaagatcattatattgaatgaaagacgccagacacaaaagagtacatttactgtgattccatttgtatacaattttagagaacacaaactaatttaaagtgacgaaaagatcaatggtcgcttggactggggacagagggaaagacacagactgcaaagggtatgaggaatatactgggggtgaaaaaaatgattggtatcttaattatggccttgtgtcttcattatagtatgtatatatctgcaacattttataaagttgtacaatttgaatagatacagcttatcatacataaattttatcccaataaaatttttttgagaaggatattcggctgaatgtcatcttctggggcttatttcattaaacatttattcgatatgatttaacaaatatttgaagaatgtaagaaggaaggaagatagataaatttatatcagtcacttctgtagtgggagagaaaaaagatgaaaataaatccaagtcttcttaaacaaaacaacccaattctagatttcatatctatccatcttagatatcaaagaataacctttctagaaccatgctcaccataacttacattcaaggctattattgctttcagtattaagggaaaacttcagtttgtatcagcaacattctctaatctgtcaagttatgcagttttttgttttgttgtgcttgaaatcttggagcagcaaagcaagaggggcatattagttaaaacacttttggctgcaagtaataagacatcaactcaaaatgactcaaaacattggaaattactggcttacataacttagaagtcctcagggatgaccaacaccgagaatagcttgatccagataccaatgttattattggaattcacttcttatttcttattattggctgggtctttaagtgttggcttcatctgtagacagactcctcttgtggtggctgctggcagtttgagctttacattcagtcaagagactctcattgttttagcttgatttgcatgtttttctttggaccaatcagtgtgggaaggaggatggaatgcactgattggcaaggtatagtcatgtgctccttcccaagccaggcagggtggaccccatcggtaccacacaaattaacagtggaataggagtgagttttcaaaggaaaattggtgtgctattaccagaataaggtggtttaaatgttccacaggcaaaaatcacagttaccctctctctcaaagataaacacatgaggtaagtgacgtcactaagaggaacctcactagtggaaaaaattttaagttcctggtcctagttgtcttccaacctctttttccaaggaccatggccatctgttcatggcacaggaagctagaacactctcaaccgtggtggtggtgatgatgaattgaaaatcctggaatggtaaatgccttcttaaacttccattaagcccagcaatctgacagtgtggctgtattggttagctatagctatgtaaaaaattcaccacaaaatgcagcttcttaaataacaaacatttattatcttacagcttctgtgggtcaggaaccaaggtgcagcttagctgggtcctctagctcagtctttctcacaagacagtaatgaagatgtcgtccagaatagtggtctcatttcaaggcatgacttgggtggaatccacttccaacattactcaggtggttgttgataggaatcagttgctcacaggttgttggactgaaggcctcagtttctcatggttttctgggttttctgtttactattggccagtgcccttcctctatgccttgccatatggacctctccacagggcagctcacaacatggtaactgtcttgaatcagaaggagcagaaagatgcaggaagatggaaagcagggtcttttggtaatctaatctcagaagtaatactccatcactttggctgaactttttttttttattagaagcaagtcactaggtccagctcatatccacacccaagggaggaacaattacatatgggcatgaataccagacagggagatcgctgggaacatcttagaggctacccatcatcttagaggctgcccatcatagtggcagtggcaacagaggaaatactttgctaatatctcttgccattgaagttttctgttgagagccttaaatcatggactggatacatgaggcggacagaggcatttccagaagctaggtaggacctttggcaagatggagtttatgttcatggttactaatgcaaaccagataaaaagacaaaaccgaaactgttagagagtttgattgtgaggtacagaaatgattacagaaacaagctgagaaaataaatgcgtgacgagaggtgaaatagagatacatgccaaggcttgtatttaaagtgttcaccacagagagaatcagccaaaaaatgtccaaaaccaagggaatggtttacaaattgcagtgtgtccatacgatagaataccatgtagctgctaaagatacttttttggaacagtggcttttaaactttttttaaccacaactcacagtaagaaatctgttttacaccaaaaataagtatatataactatttgaactgaaataaaaatttcatagaggatgtttatccattgtacataatatgcactttgatatttttgattctattctacaacattttttatagtggtaaaatgtgtatattgtagaatttaccattttaaccattttaagtggcattaagtacatgtacattgttgtgcaattgtcaccactatctccagaacttttccagcttctccaactgaaactcagttctctagctcccatttccttcttacccagccccgagtaaccaccattccattttgtgtctcaatgaatatgactactctaggtaactcacataagtggaattacacatttgtccttttgtgaccagcttatttcacttagcatgatgctttcaaagttcatccatgttgtagcatgtgttagaatttcctttctttgtaaggctgaataatatttcattgtatgtatacatcacatgctgtttatccatttatttgttgatggacacttgggttgtgaaggtacttggagcaaaagtgtgaaacctctctgtgagcatcaggttgaaaatctctgttgagtcacagtatcctaaactgcaactaaggtcctcttctcccttcattttcatgcttaattattattattattattattattcgagacaggcccttgttctgttgcctaggctggagcgctatggcaccaccacggctcactgcagcctcaagcttccaggttcaagcaatcctcccacctcagacccccaagtagttgagaccacaagcatgcaccacaacctctggctggttttttagttttttgtagagatgggatcttatgttgcccaggctggtctcaaattgttagactgaaactgtcctccagccttgcccccgcaaagtgctgggattgcaggcaggagccactgcgcctagccttaccgcttaatttgagagacatattctgtagatatacccaaatgttgtgcacaaatggcgtgcactgtagctgggattgacaagaatcacgctttgactttagcaaccctgaaaaatgttttttttttgtcatttggttgcatgtggtttatagagattattctgagtctgggcattaaattgattagttgtccttcaaaaatccatgggttatggttctaagagaaaaagatagcaaatcaggacacatgtgcacccctgcatcaatggtagaaacttattcctgtgtcttctcaagtttcatttgttcattaacttaactaccatttatcgaacgcctgctcactgtaatgtcaggcacagtcctaggtgctgggaatatgggaatggacaaattaaaatactgtccccagaaaaccttattagcctcttagtaaaagagagagagaagtagatcatttaacagactgtcacaagtgctacagcaattttgtaagatgacttgggagacagacatgatgagcacccaattcagcttgggtaaggacaagcttcaggaagactgagacgaatctggaagaggatatttaaggcagaaagggcagcatgcccaatgagtagaagcaagttagaatgcaggacatgtgtggtaagatgagaaggtcataagggcctcatgtgccgggtgagagagtttggatggtatcctgtggttttggtgaaccatggaaaggttttaagcaggacaattatttggctatatttatcttttggaaagaactctagcagcaatgtggactaagatgaagggaatgggaaggaagtgagaccaggaatgttataattgtccaggaacaagatgttgaggatcttactttgaagcatcatcacgtgaggtgaacaggaaagaaagacccaagacaagcggagaagacagaattgaaaggtttagaactaatgggctgagggcaagggagaagttaagattaaatttctggcttgctggctaatattaaatgattctctagtaatctgataatgaaccattaattgagtctttttccaaggagccctattgtgagaaacgtttgatgattttctcaggatatagctgggcaccctttctaggtggcacatcctgcaagcttctttcttccattatctgtggaggtatatttatggagagaatcttagaggttaaaaattggtctatgcaggatggctagaggcagaggaggtgggaaagaagcaaggaaagaagcggccattgaaactagaacatggtactaagggttaggataaagaatgtagcaacatgagtctggaagtagaaataagccaccaggcccttagctgggaagagtgggagatttgggggatatagataaaaatagctcagggcacagatgatttagataagactgtaagtgatatgaaggcagttggcttttagaaaaagttttgtagagatataattcatgtatcgtacaaatcacccatttaaagtgtataatttagtggttcttggtatgttcagagttaggcagtcattaccacggtcaattttaggatgttttcatcacataaaaaagaaacttcataactatgagtagataatttctctaattctactaatggccatttctctgccctctaccccctgtctccagacgattactcatctcctttttgtctctatatgtttgagtattctggacacatttaaaaaaaattcctcccatctaactataatttatatattcttcaatcaacttttaagtggtgcttgctgcttattatgggggcttgtttgcttgactgaccatactgggccagtagggtaggggacaagtgaagggaggttttccaaaacctcttacattagaatcatgagctgactctccagctgtccacctcatgatggaccatcctatgtgtaccttaaaaatgaaaatgaataataaattttcataaaagaaagtgctgaaatcaaagtggataaagtgattaacatggacagataaaaaattcagtcaccaagcacttgtacaaccactcacaagttgaagttgcagcaaataatttagatattgctggtcgaatgacatgattctagctgggctgaagctactctccatggagttctctgggtaccttccatgacacagtgataatgagccataagtgctttccttgaagaattcttaagaatcagaccatgctcctttagggaaatttacttgttttatattatcagattaataagtgtagagagggaaaccatttgcctgctaatcaatgggggatatggaaggagtgatcatgataatgataatgatggtgaagatgataatgataatgataataacacattgcatttgagggcttactcctgggggaggcactctctgaagggctttacacacctctctatttagttctctacctgctccttgagtacctttaactatagaaaaggaggctaggttcaagagatattaacattatagtaatgtacttaataggagaatatacttaattggagaagtaggactgaacttggctctttctgctatgctgctgctacatctccgattctgagatttttcatctataaaaaggagtaacagtaggcatgcatccttattaggttgtttgctgctatgggaactaggtgagttaatacatgtaaactttctaggaccatgtctgtcatctagtaagtgcttaatgaatattagccattattttgtattattgttgtcattactattcaatactacttttgatattaaaaaaagatagtccatattttaagaaaaaagtagatggtaagaaaacagaaatgcacacacataaagtcagtgaaaactacacttcttttccacttccatcaaagactattaaatgtagggcctgctattgtatatttattcagacatcaatcttaatcagctcctttgctactttggcggtaagggcattgtaattctatttttatcggttccttcctgtgcaccagacattcaaaatagcatgagtaaggatcaaaaatatcttaatggatttggttcccagagatatcagtgaccaggggaagagttttgcagaaatttcttcctgaactgataaggaaggtaagtggggaaggtgtagggagggctggctatgcagcttgctgttaagtctgcatggtgtgaaaggcaaagatccagtggtggagtgaattacaagggtccctggaagaatctgggggatcagagcataaatgcctcctattttcaggtttatgattgggaccagtgttgtgtaatcattgaagataatactgacccctcatgaggtagccatggttttggtgaacagagttcctggtgtgattgtgttacacacacacacagacacaatatggaggttcctatatgattaatatttttatttgtatatcttgcctgggcatcttttctttcttttctctctcctttcttctttctgcttctctcctaattattttacctcttctcctccttttaccctctttttccccttggcctctctttcactctcccttaatgccattttatattcagactagtcatcatcaaaaagttatcaaagtttgtaaactgagattgatgggaagagaaaatgagattagaatatccagaacaactatagttcttacagcaatgcatacagtggtaggctatgccacatggtgaagtgtgacacaatcttaggtggtgcagaggtgcacatttgttctttagtaattatgtatttattgcatgcatattgaaagagagagagagagagagagagagtgtgtgtgtgtgtgtgtgtgtgtgtgtatagtatgccatatttgtgatttcatggatattcttgtttaggatgaggataaatttatttaagtaataaaagtgataccatatgtagagaaatacttagtaaatattagtacaggtggtacacagatgtagctaatgaatcatgactctagtacatgaggactgaagcttgggatacactgttgtaatacatggcatcttttacttgcatcggggggcctctggggagagctgtaggatgtggttgttggtccattccaagtgatctccaaggagcctccatgttgttttgccttggttctgccatagcatcagtaagcacatcttggagctaaggattctgaataaaaccagccccctcctacccccaacagttccacagctgcatctcttgatgaaagcccaaggcgtgagcaataactctgcaccagcaactcgagtttttaaacatttaaacatgtgtagcaggtgtgaatgttattctatgatatgcagatgcaagaaatttcacatcaatatatttgtttgtttgtttttagagtagaagtaaatctaaatctgagtcttgtctcttggagtgggaaagaattagatcgcacttgtaatgggggttcactcgaccttggctcccagcccagggcctgggggagatccaggccatttggtgggagccctctggactgtggtccacactggccactgctgatgggtcctctgttagtatccatcaggtactgggcccttaaaatcaggcaatgtctctgttttcactgacttgggcttggggatcccttcccaagctgggagtgatggcatgatttgggacatcacacagctgtgccagctgagagcttgtcactcccccactaagcctgcccccttgccaggaattccagctgagtcctcactactccagacaatccctcccttttcattctagaggaatccccctcctgcttaatcttgactgtgtctggaagcccttcaccctcacccctgtctccaaaggcactcacctggctctcctcccatatgtgttgatctagccttgtgccctcagtgacagcaaaagccagaaagtgtgggggtggggtgtttttgcaacttctgtttaaaccatcacatacaaacacccctgaggcaaaggggcacgaggtcttcttagaataagggagagaaaatcaaacacagattaatatctctatcaacaattctgtcatgtgaaggaaaaattcgaaatttttgtatatgcataaagggtatgttataatatgacacatacatacacacacgtattcaattcagaggctcagaagtgtgttcaaataggcatatgtattaagcatggtttcccgttgttaccagagttggcatggaattatagaatctaaatgttatgcttgtataggccttaacaattatctcttccaaatgcattttatccaaaaatgcagtaggtatttggggccacaaagcactgtttcagttgaatttgcaaaagcattcaaactgggagaaaataatagaatcagcccagtttctggtctaacctttggttcatttgcatcactgccccttcagtattgatgttttaaaactcaatggctaccctgatcctttgctctttgcattcagccccattcctcattgccctgctcccctctgcatcaaagggcagattgacctctgccatctagggtccagcgatccctgaagggccctttcctcaatggatccagctggacagcccaccattggaccggatgtcagggtgctcctggcctccagctgagcagcacctcttcctttcatcactccagccccatggcagggtgcagcatctttcggttgctaaatccacattcctcttctaacacttttgaaagtaatgctccaatttaatattaattcctagattgaattacctgactctatcataccttgctctcttagctgaatcctgattcaaagggggaagataagtctattaagtttcagagactaaaatttgtaggtcagaagcttagattctatatagaaatccacaggaacaaataataatacctttcatttttgtcattcaatagttatagatctattcttcttttgcaggcttaagagcaaagagtgtgcactcatggagttacattctagcaaggaacaggccaactgaaaagaaaagtaaaagaatatcaggcactgagaagtgctgtgcacaggagtaaaataggatggtattttaatatttggggaaggccttgtaattactataagcttggatgtagctttcaaagacactgaagccctatacagtcatccctcagtatatgtggaggattggttgcaggacccccatgtatactcaaatcagcacatatatacaaaaagtctgccctccatatacatgagtttcacatcctgcaaatgtattctcagtctgtgtgtggttgaaaaaaatccgtgtataagtggacccacacagttcaaacctgtgttgttcaagggtcaactgtactgtttttgctgctgcttcagattctacttaccaaaggtcacaaattagggctacatttggaatctaaatatgttgttttccatgtgcagtattttatttaaacaaagcagaaaaggctaggctgggcatggtggctcacacctgtagtcccagcactttgggaggcccacccaggtgagcggattgtttgagaccaggagttcaagaccagactatgcaacatggtgaaagcccatctctaccaaaaataaaagcaaaatttagccaggcatgatgccgtgggcctgtaatcccagctattcaggaagctgagttgggagggttgcttgagccagggaggctgatgttgcagtgagctgagatcatgccacagcattccagcctgggagacagagtgagaccctatctccaaagaaaaaaaacacacaaaaaccaaacaagtttaaaggtcttcttgtggaacatttactgtccagtgtgtggtagttcccataactatttccaattgttttatattacagcctcaccagcttaccatatctacatgaactccaaatgcagttccaatgtgaatttgagatcattttaatttgcttagcatcacttccgtttgagaacttaccatataccagatactgctgaacagttcatcttcacaacatactttgtgaagaaagtatactaactctaattttcagaccacattgcttagacctagagattacatgcctaaaactatatagctagtgagtagtagaaataggactgtttgcttactactaaagcctatctcttaactgagttgaattgaacgagcctgtgatagatatccgtggtgtcttatttgtgttagcaatgcctccccaacctgataagttccttgaagacgagttagttactcgtctaaatccccacattatcacaatagaaactaaacacaaattatgaaattataattttataaaattataaaccataaaagtgaattgattagagataaaacaacaaatcatagctttgaatattcccaggtttgtctctgaagttgatcagagattcttctgataagcaaaataacttagcaggtttctgcccaatggcacaaaacagacacatgaaatgccaactgtttatccagatgattagaaaacagccagtttgaagaagtgaaaagcctgagtttcaaagtggcttattaaaatcaagtacaacaagaaactaaaggtaaactttttgacattaccatggcaaagtgagaaagaaaggatgacatgtgtaagtaggttgtgttttcaatgtagtgttatcaatttctctttcttgggaaggatgatccctcattgtgaaattatgtccatcctactttttaggcttaaattttttaaaattgaaatgtagacgatagtcaagtggtatgtgtgtgtgtgtgtgtgtgtgtgtgtgtgttagtatcctttcatggtagaataaaaattaacaacttattagtacctaaacattccttgaaattttactagtccatgagatccaagtctgataacctctgcctctgataaaagatcaacttaaacaagctgatgtatttatcatatcacttacttgttaggataatatttacattgttattaaggtatcatagatatatgtcgatataactaatcaaatttatattgaacacttgctatataccagtttttagtcaaatagtttaaatgtctctttgaattttgttttttaggtattgcgtgggtaaatttcaacctagctcttccctgacctatattttctaaaattcaccattgtagggttcaaattatgtgttatttcatttaagtgtgtgtgtgtgtgtatatatatatatataaaataacagtttagacataatcccatatcagttaggatttttatgttccatgcaattttatgttaagaaaagtcaacccaaacaatcttgtacaaatgcaatctattgtctccatattttaaaacttcaaaggtagatatggctttagagattttgatgtggccttaacatgtaacccagatactgtttcttcctttacacttctgagctccatttctcacaggttggctccatcctcaggcatgctgtctccttaggctttcaaaatgatggccagccacttcgcagaactaagctgggaggaaagagcaaaatccagagactgagcctgctggctgatttggctcctatgctcatgcctgcaccaacctccagggctaaaggggtggaatgcacaaatggccttagcctgggtcacaagtgccatcttgctgggcctgaagtgcagccacttcactgtggatccccaaatggaagttggggctgttggggagaggaaatggaggaatgagtataggaaaccaactaacaaatgtccactacgagctgtttactgggggtaggaaataaacagcttgtctttgaagctcattttctttacacaattacaatcatttggtgtttattttcttcagttgttatcaggattacattgcaattgatatttcaaaattgccctgagtggatagccgagaaaaccttcgtagtgagataaatctgtacaaagacaaggtggtagagatttctcacttcttatacccctgttgtaagtttaccatttgaataaaaatggacagattcaattgcaaagtcattgaactattgctgactcttgtttccttttaggaaaaccacaggttctttaggaaagtcaacttttctccctccaatagttaatgctgttttcccaactgttccccttctgtatgacccttttctttccagatttaaaatctcttcatatgtgccttttaaaacatcttgttaaactttccattcatcaaataaataccagatgatagggactgtgcccttttccatactttttgccatgtggataataaatacatctatttacttcattttccatcaattaaaaatactacagtggctttttatttaatcgattatatggaagttagaggggatgggaatggaacattattagacttcttgtttgcgagtacttggacattagtaaacttctcttggagatccagtccaggaaaatagattgctggccagaaatagaaacagcattttttccccttaataaaggaagtcattgtttaaaataatacttaaaaattttaaaaagactaattgtccctttcctttttaagagtatttttgaacatacttttaaaagactcttggtatcttcatattattttacaattatgcagtgattttttaatgcagagcgtgtattgaagtctattattccttcccgcccaagttgagtgtataagttgtgggtgatttttgctctctttccagctgtgtcatagaatcacacaaatgagttcatactggggcttagtgcttgtagattttccattttgtttgctttttgctgttttcagtgtattgttaggttaaaggaatgcttctatctttgattactccctggtaatggggacatctttaccctggaaagcaggaggtaatgaagaacaggtgttcaatgtgaactttcagttttgttttctcagaaatgtgcccaaaagtagggcaaagctttccaagttttttaacgcagattattgtattgatagctgcagtatttcccctggtctccctccagcacccatatcccaggcctctgagtttgacagcacttgaaggagccatgaaaacttgctaacttacaattgataagttgatcaaatgaatttatgcaagacagtgagtgcccagcatctctgcctcaatgtttacacaggataatctcctagaacgtagcaaagttttcatttgtggtaagaaatagatgttgcttcccttcagaatctgaaataagattagacaaaaaattctagagataaaattgtcaggatgaattttgcttaaatatctgagggccggaggaacatttactcttcataaataagatttagcccccatagtcaacttccagggaacatctctattttttcaaggtcttttttttcatcatatgcctgcctcagggtgctgaactttggactgtaaggtcaggcaagtctccatctttttatcctgcaacaggcctgacagtctttgggactccttttcctaatgcagacgttgtagtttgagtcacagcagctacggagtgctttccactcgagcaagggtagacttgctggctctcaacttcgctgtggcacaaatgcagtactcaccgaggccagttctgtagcatctctggtgcagcgtcacccttttcctaatatattcttttcatttttttattggtaaaatatacataacataaaatttaccatttttaactattttttaagtgtacagttcagtggcattaagtacattcacattgttgtgcaaccatcaccaccatccatctccagagcttttttcgttatttcaaactgaaactcggtatccattaaatgataactaccattcctccttcacccgagcccctagcaaccaccattctaccttccgtctatacgaacttgactattttaggtgcctcatataaatggaaatcattcaatctttacccttttgtgtctggcttatttcacttagtctaatgccctcaagattcatccacgtgtcagaatttccttcctttttgaagctgaatagcattcccctgtgtttatatatcacattttgtttatccattcgtcaatggacacatgggttgcttccacctattgactattgtgaataatgctgccatgattgtggttgtacaaatacctgttcagattcctgctttcacttcctttgggtatatacttagaagtggaattgctgggttacatggtaattctgtgcttagtatttttagggattgtcataccactgtacacagtgactgccctattttacattcccaccagcaatctgtaagctactttttagcagacataattcccatcacaccctactctcaacaatataaaaccagtattcatctgattcttttcttaatttaaaattaaaaattttaaaaatatttatttgtttatttaatgtctttattttttagagacaagctcttgctctgttgcccaggctggagtgcagtggcactatcatagttcactgcagcctggaactcctgcgatcaagcagtcctccctcctcagcctccagagtagctgggactacaggtgcaccaccattcctggctaactttttaaaaaaattttgtagagacaggaatctcactctcttgcccaggctggttttgaaactcctggcctcaagtgatccttccacctcagccttccaaagtactgggattacaggcatgagctaccacgcccagcctgattcttgtcagtaaaggtttttctccatttttggggtgagggggaaagttggacactgcacttatattgtcgccacgggaagcagaaatgtatcaaaagaagacaagaagaaaaaagcaaaaactatggcaaaatgcagaagaaaagccagcattcacaaaggatacaggaccctctggatttaaacagaaaatgctataagcagggtgtgaaactcccatctgtccattgctgcttccttttagggtgtacctgatcttgtgtgtgccaagtacaaaatgccccgtgtgcctttgtaacggccaagctcccagtgctttctcattcccacagtggccatgtggtctacaaagtgaagcagacgccaggctgactctcaaataaagcctccttgctgctgtttgcctccagatagttcaagccatttcctttcatttttggaaaaaaagagtgtcagtttggctttctgaaaacagttgccacctttgggcaaagctaattaactacaatacacatgttcagttcaggatttccaaagagaaagaaatgtttgatactggtgtatgttacccaacctgaccacacatatggcaggtttgggccaagaggagggagcaggaggacattagttctgatttcaggtaactgttaactcgttctacttcttggaataatatgataccagagagagagagcttctatgtgaagctttgtggatttgaaaactgctatactgaatattttatgatcttgtcaaggcctccccttatcatgtgacctcaaggcgctaccatggctttcatcttgtgaagtcttgaacatttgtagttgcagaaaaacctcaagagactcagtatttcaaaagccatagtttaggttttattttctaggctgggatgtttgtgggttttcttattataaaattagagttgtcatagtgatgttgtgtatttcaaaccagatattctgtggtcgcagcaaagtctcactttaggaaatggatttctttatgaatgtgctaacattgtgcacagaaagtagcacaatacagataaacaggcatctttggtaggtggggtgtttgggtaaatttaaatttctgaggattgaacaaaaactcctttaccttaagaactgtgcaagcactttgggaggccgaggcgggcggatcacgaggtcaggagatcgagaccatcccggctaaaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaagaactgtgcaaaattgtcctaaaaaaatttaagtagtctagtctctagatgtccgtagttaacataattttattgttctcactcatccagctttagaacacatggttcctgaatacaagtctcagctttgacctcagtgcttgttaacccagtgcctcagcccttcttagacatgaatcagaacctttggtggtagagcaggaaattggcactttagcacccagggtgatttttatgcctactaaagtgtgagaacaactgactttgaagctgtaggtgtttgggttggtggcgtatttatccctagaattgctccgtgtaatttgatgatgaggacatctttctgtttctttcctccaaaatggaaggcaaactaaattaaaatccagttaattcaggttctgagttgattgggacatggataattgtgatctttttgctgatttctaaaatattttcccttcattatctgttggatttcaagtgcattctgctctgtgttatagaatgagggttgatgtgaaacttagggagactccaattatatacatggttcaattactggttccataatttagggtgtcctcttttcccattgactttcactttcttcgtacttaaatggcaaggttgtactctctgatctcagtgtttctttccatctctagcatcttatgatttccttctttattttctaactttttctcttccaccctcaaaacattttctccatgcatagaactagaaaggccctttgagatcatttcatcttaatctctcattaggcacgagagaaaataagctgaggaacaaattggagatgctgctttgaaagagcccacatgagagcctggggcttcagctctcacagtagagctccttgcactgtggcatgaattgcttatcgtatgtggggctccatttcttacattccagccctgcccgataagtatttggtacggcagcagcagaggttgctctcaacatttggacattaggaatttaatgtgttaggattgattcatatgtgtcatcaaattgtatctggggacagagattctggggagactcacgtatgagtttggctggccacaagtaaaccccagatgactcttgttactaattctagaatacccaaacagcatatattgtgaacttttttgcagtgtacttgaaagggcatgacctttgcactccgaactatgttcaaatcctggtttgggaatttattaactgtggaaccctaggcaggttaccttacctctctgagccttatcaacataaaggttgtgaaataactagtttgtggattaaatacgatcttacatgtaacgattcctggaatttaatgggcaccaagtaaataccagctcatggatctttctttacttgttggtattattagagtttgaaactttgcaaacttgggacacataccaacaatttgaaaatacaaagggggtaattttaagcttcttgcgatatcagctttcagcaatttaaaaagaaggaactgttttttttttttttttggaaaattaggaagtcaaaatgccagactcatctataaatgcgaagctctttttgagcttttatagtacgggcttatgacatcagtaaggatccagccccttcattattggaacctgtcacagaccagggcaggaaacctctcccttattgtgtctccactttttcttgttctcagagttcctttagaacatgtccagggaacattgctggatgtgcattctcaaagcatgttgctgtactccataaatgctgataagctttttccccagaccaacagaagtcatataagtgaaaggacagagaagaaaatttatcaaagaaagagtgagaagaagattgacccccaccaggaatggaattttctctctatagcttactcctcttgatgaagtattaatttttaacaggaatacggatcacttttttccaggtgtgaattagttcctattgtgaagtatttgtcattccaaaccatttttgttcttattgctagctgtatgattgcatgaataattagtgcccatggagtgctttaagagcctaaccttcctggaaagacagtgctagtgtaaagggtcttatatatgaaaccattatggcactgtttaaggcactggaaaggtccagaatattctgtacccatgagaaaaaactgggctaaaaaacagaaagtgagtgctaggctacttctttttagtcctctttctatttgattcttagggttacagaatatcaggattgtaatattgcttaaagtttatctaaccatcaagtacatggattcctctacaacagtcctgtactacacacacacagacacacacacacacgcacacacacaggattggggagaaacacagagaaagagagaaagaaaatgagaatgaatgaatttatcaactctgctttaccgcccaagtgatgtatggaatgtgaccccaacatctgttaccccatatatggtcaagattgatttttgttggttgggtaccagtccctcttctgctcattgccatgtgtttattcccctcaactgaaccattcatcagttaaggatatgtgtcctactcaaaccccttttctttgaacccacatccatctaatgtctttgttcacatgtcagacagctcctcaaatagtcaaagggaacttggcattttccttaatcgtctcttctccagttgaattttcccagattcttcattcattccttatttttgagaatgaccagcaaaactaaaggaatggctgtaggttccttccattatttatataatgcagcttttccatagagaagcaatatttataaaggacaaataaagacatgtctgcagagacagtgaaattcttagaaagtatgctgtacttgaaaggcaagacacagaggttttgaatgcaagctgtgatgaaacattacccagggcagcgtcctgtctgtgttagagtggagaaacagagtcatggagcctcttggtcaaagcgtcactatgtcaatcttgcagagcagaacggctgtcaggttaacgagtgctgcatgtgcccagaggcagttctgagcatggtaggactacccaggtgagggctctttacctttgtgagtggggagctcccatacctcatcatgttaagccaagctgatctggaaagggacacattccaggggagaatcgggatgcttaattgatttacaccgttgatgaagcgcacaggcatgaattctggttgcctaccatcccatatggggaggaaagcgtaagttgtagaagccaccttttggcattaaaaaacaaagggcgctggagtaacataaggatatatacttagctttttctttttaatgtatgaatggaaaacaccttttatgcttcaaatgtatattttaataataaaaatagaactattgccaaaattcactccagaaggcagccttttttcttaaagcacaaagagaaagagaggagagatcaagtgtcttctcttttccatgataattgcttgtagtccctgctaactggccttttgacagggtcactggcagagcttgtgggcccccttggcgatgttggttggtgggacagagtatgggccagtgcctcagcaggaatggggcagaaaacagtaggctggttcccaggcctgtttgctctgagcaccagccaagccagggttggtttttgctcacctgtcattgcagcaatatgtagtgacgtttcaaactgctagcatggaaacaaggtaaaaacttcttgggacaactgggaaatttcatttagacagaatgtcagaccttagcctccagtgtaaatactagaggctttgctctgtccagttatgcagtagcatttggtgtggaattaaatcagaggctagtgaaaatccaggcaggatctaaatgtgttgagtacatttaagtttcttctctaatttaggaaaccttatgcttctccaccctttggcactgacaactacctgaaagaggccctaacagtcttgaataggaatatgatcgctagattctctatcacagaataaaaaatgaagagcttataggctctctgattttttttaagtgctttggtcttcagaatctggcccagcactagttgttttgatttgcccagcaacctaacccatattcttgaataagcaagcaggatttcagctctagaagggtgagctgcatatattcacacaccattctattcatttttcagatacaggattttttaaaaaggagagagaacagggtcattttcattctattgcaaacgctttttatgtttcagggatcaaattatcaaatttcaggcaactttttttttaaactaggtcatgactttcaaaggccatctttattatcctcagcagaaacattaaacttgtaaaaaaaaatttataattttttttcctctggtgattttttttcttttatttccacccccacacatacaaaaaatgctcggggaaaatgtttgccttcacttcctgctattcagcactgtgtattgttaaactgatgtagtgtttatacacatcgtggttatggctgtagcccggctattgttgaaggatgttagacagccatttatcacagtacgccagtaaacccattgtaaaaatgtcctactagttaaatgaggcttagatttaatgaggctgtaagagcagaacgggattttgacatactgtaaataaggttcctatagaaatgtcatcaggattaaggtgcagattccttttgttttcaagcaacaatagtctccttgccaaggtaaaaagaagccccctcccttttaaatgaatcttttgaggaagttgttgtttgctcagaggaatgcatgaaacaagggtgtgtggccaggagatgacaagatcagagatgacttctttgggaaagagacgacactccccagaactcctttgtatatcacagccacacctggagccctcaaagcctccttgttcatacctgctgctgcatgtgaatgccattcaaatgtggtcccagtcccctcctcaaggagggcaaagccagcctcagaaagacttagtctgagattcctggccagcctttgaagagagtaatcaagttagacatagcaggagggcatttgccctttcaagccaagtggggaaacagagccagtcttctttgcttgatcttatcagtgttcaatgagatctaccattttgaaatcacagaacaaactgtagaaaatgaccagaaattcttgtgcattcaattttccccatgggaaggaaaaatcagttatttccccaatgtctaaggaaatgaattcagagagaacgtctccatacgcagccagaagtaggtacgtagggcttggcgttaaccactggggttgcagtacactatttacaaaaacaggcagtcttgaaattgccctattggagagaaatttgattgtcccagaaataaaataaagtggtctccgtcttcattttgctagggctcctggaaagcctcaattcaaagagatcagtgttgaaaaagactaaattgaaggatagcttgagagccaatagatgatctagaggcaacccatccacatctgcagtttccttagtatctttctgaacctggaacgctttagaggtgtggagtcttcttcgactgagtcttcaatttgacataacagtgtatccctttaggcttgaaccccgaactcacaaggtcttagggaatctgttgcttctattttggtggtcaccagaggcttaattttagctgctgagagattagtcttttatatttatttaatgttctcagtgggggaagaaaagttcaagggttgtgtttgccttcaatgctcactgcacataactcattttgcatccttgcagcaaatgcctgctaacttcatcaggaagtcacatttgggcaaggtgcagtatgtgctgggcattcttagctagaagggccctttctgcaatgtctccatctttagctgcccccaccaaggctcttttttttttcccagatccctcttttgctgtaagtttccaccatcctttttgcagagccacgtagaataatgttggcagagaaacttagcgatgctctcttagctcttttatcctaatagtggtttctgtatcctcacactgctagacagaatatctttctcaagacaaccaaaggcagctttttcaagaaaaggatacagatctggatgcacaacagtgaatcaggcataatcctgccactccagagctcatgaaccagtgcagtcattctcaagctttagcgtgtgcagtacataccttacccccagaggtgtgacttagtaagttcgagttggaccccaaaatcttcatttctcacaaacactgcagtgattttgatgcgaaaaacctcaagagaaatactgatgtagtgaggcagagggaacacagaaacatcatgaattacaaaactgcaggaaccgcctgaaggaaagtcagagtgctgtgggaatggagaaggtatgggtgccacaggatgggcctgggcagggcccacagacacgatcgtgtttaagccagatcttgaaggatgactcaactgtggacccttggcagtgctagagggaaggccttctgaacaggaaacaagatcaaggtgactgaggtgaaaggggaaagggcacataggggtcagtgcagccagagtgctgggtgcagggaggattctgtttggagctcaagaatttggagtttagtcttaggcagtgagaagcccttgaagatttttaagtagagaagagaaataatctgctttctgctttctttccacagtgaccacaagtgaagctgaggtggctttgggcagcattaagtgaacaaaaagggcaaaatgagaagaggcaggaaatgggaatcgttttacggctccctcctacttcccacatttctttgaggccgaattaattggtgtgattccattctcaatttaagaaatcaaggttaaatgacttgcccacaattgcattgagctggaactagggcataggtctgctgtctccagatctccagctgacttcccaccgcagcctgtcagtcagtgaaattaatctgcagtcattcgcagacacctgaaaatgtcccctcccacccctcaaattgcataataatgagtcctacagcagaaaacagttgtattctttcaaaagtttctctaatgtttttgaaatacacaaggaaatagtaaaagttaagtgaacatttgaaatacaggcttcttttatcattaaaataacgtctcccatggagtgagagtgagggtggtagtggtggggttcctgagattccaaatagattgtacttctggccctaaagattccttattagcaaaatctttgaatcagccaggtttgaatgataaataagaggacactgggcatttggaatcttcattatctatcataacaaatattgcctctggcaaagaccacatccctcagtctgagctctcacttcaaactgcaggggggccaggttagcagtgggaattgcatttctaagtcttgacagccaaggtccttagacaagaggggcctaagctttgtgacatctaatcctcgaatgtaacaaaagcagctaaaaggtgaagaagggaagcccaaaaggagaaaaaaataagggggtgagatacagcttcacattgagtttcaaagctggaagacagcttatagatcatgtagtcaaagtccccatcctcatctttacagagaaagaagtctagtcccagagaggggaaccgatttgcccagacccctacagctagttaggggtgacgctagcatgaagaagccacgtggctcttgtcaccacaccaagctgttgctctcatgtctcatgatacaattgtgctcacagattatttcccatggatccactgggatagtttatgaatcctttaaatgcaaaaattaaataatactgggaagccagagagcctatgagatcgggttcagtatttttactgtttactggctgtgtggccctgagccagatctcctctgagcttattacttcttctgaaaaagggggctaataatctatctgtacccgatacagagtttctctgaggttaaaatgtgtcatttaatgtggaaatgctgtacaaactggaaaactccactaaaacatatgctgttaaactcttaaatataaaacttgggtgctgaacaggcccctaggaagttcacatatgcagctattatttttctgtgaatttgtttatagggtgtttagaagcacctaggagtggccatattgcttatcctatgaatgcaggttttggaaccagagtcagctattgtcaaaaatcccagttcccccatttgctcaattctggttatcagtggtttacttcacttctccaagttgagatcttcatctgtaaaatgagaccaataactgcatctaatttataggagagttgtgagaatcaatgagataatatatacaaattactctgtgtcacacctgaaataaaggaataacttatacacaatgtctatttttactcattttgctttagttgttgtctttattattctgatatagacaaggagtaggactcttggaaccccatgagggcgggttttaggctctttgattaaccactgcatcttcaggtctgacaaggcctggcagtagcagatgctcaattaatattttggaaaaaagtaatgagttcatattgtaggggaataaagaagggggaaaaaagaccctttcctctaccctcttatgttttgtggctggcgcctgtgaattcaaaagacactagaaaggttagtaggagaaaaaacatacagatttaattgatatttttaattttacatgcacaggggctccacagaaaattgaaaaccaaaaaaagtggttttggggggcttataccattgaacaaatggcagtaaattgtggagatatgactagacagaggaaagggggtttgggcatctagggcagatgaattgtgagaacatgacttggaaattttgggggaaactaatggaagagaagggtaattttagtaaggtctgtttaagcagacttatcttggtgctggctcctcacttctcatgatagggtatctctctttatcttggtttaggaggaagggaaatttataccaccatcacaaatggaagtttatgccctgtttttaggcagaaaaggggagaacagataacttttcctgtatctgctgattctttctttttttattgaaacaaggttttcctctgtctcaggctggagtgcagtggcatgatcatagctcactgcagcctctacttcccgggctcaggtagtcctcccacttcagccttccaggtagctgggactcaggcgcacgccaccacaccctaatttttgtgtagagacagggttttgccatgttgtctcagctggtctctggtcttcaactcctgggctcaagtaatctgtttacctcagcctcccaaagggctgggattccaggtgtgagccactgcacctgtcctatctgttgattctccgttgctttcagctcaaaaatactccttatgacaaagcggcatagttgggggtggcatatcctggactccttcaatatataaacacagcagaactttaacatttatgacatcctgattaatgtaatttttagctatacataggggcattcattcattcattcattctcttaacatttactgagcaactaccatgttccaggcactgtgtttgatagtggatatagattaaggaataaaatagacacaatccctgctgtggtaaacttaaaatctagtagaagagactaaaaaacaggcaagtaaacagatgactaaaacaaaataatccagagttatgaattatggtaagtactatgaaggaaacatacagcatgtggttaaaaatagtggggagtggccgggggtggtggctcacgcctgtaatcccagcactttgggaggccgaggcaggcagatcacctgaggtcgggagttcgagatcctgaccaacatggagaaaccccgtctctactaaaaatacaaaattagccaggcgtggtggtgctactcaggaggctggggcaggagaatcacttgaacccgggaggcggaggttgcggtgagccaagatcatgccattgcactctagcctgggtgacagagtgagactgtctcaaaaaaaaaaaatagtggggagtgcttctctgagatttcaagaaaggccttctaaacataaaaatgttaatcctttgcctttcatccttgtagaataaagttatcataaaaagcccatttccttgtaggtcaaaatagacttatagcagtaacctcctgaatggcagttgtaaggatagatgtgataaagccgtaacactttagtgtgtagcaggataatctgtggaacccgtgtaacaatcagaagcctgggcttcagaccatagatagggagtgaggcttctaggtgggaccctggcaagggtgtgtttgtggaactcatcaggtgctcctgctgcaggctcaagtctgagcgcccagttcaatccagggagctgttgatttcttggctggttgactttgctgaacatcatggctccctccccacaacagggatgttgctgttgaaagcatgacatgcgtagggtttgatgtgagtgacatcaagatgtcctttagtattccattgcaaaccctttcccctcttaggaaaatgatgcccttgtgatttgactcattctcccccaagaaatgatgctcattcacgtctgaaaaaataccccctgtatagtaaatggtgacaacagacagggatttccctcatcttaagccagggcttctctctgaaaacatctcagagtgggcttcagttttgtaaactccctgaaattgtaggtaaattgtgtgtccttggtgtaaatatgaattttatctttcgagggtctatagctttcttcacattcttaaggggatctgctccctaagatcataaatgtagtactggatggtagggtgacgtctcgtggatccttgtatctccagcacctagggcagggactcacgaaacctctcaggaaataccggttgattgaagtaaagattcattctgaagcagacccctctagctatcagcaaaggacaaaatccacactcggcctttcttacttgcccctgtttaactgcgcaaactcttgtttgctgtgccactctctttcgtatgcccgtttgcacctggcttcctatttatcagctatcaatatccagcgagtgctggctcttgtcagtctaatttctggttgctgccgcttcttgacaccccacactttatcacccacacactgctcggctcctattacaactggtctcagcattgctaataaacagcaacaccaaagccatattttctggtccctgtcaggccactgctttcctgggtgaaataaaagtcctattaacatgctcctcctcattgcctctgacagattgattaattaggcctcctctttagatgacctctgcactgacacgacaaggaggtggatataaaatgaatagtttgcccatataatgggctactgtgggtttggggtttttatcaaatcagactgtcggaagttacgaacttgtatgaaattccatggcttgcagcagcagcagcctaggatggcttttggtccagtggaatctgtcacatacagataggacttgaatgccaggcactgcggggcaggggagaacccacctgacaaacagccgcctgtctacctgaatgatctctcgtttatgcagcccagttcatagagtgcaaatctaatgttcttttaatgttatcaaataaaatcaccttttgttttccacagcttttctttccctccatccctccttccctgctagaacacccaatacgttaactttgtggttgctttgcctctcagaacgctaatgcaaaaccattacaaaagagcacttgagttaaatgtccacatttccattataagttgttgttttcagagaaatcggtaacttggacataaaaagtcattttagactgggacttggcgtcggggggggctccgacagtcttggcaaacaaattaggctgcttgctttccattaagagagtgtggattccgaggggtgctcgttggctgcctttgctgttatgcacttctttagtgagggaatggcttgggaagccattaaccagattgaaatatacaaggagctctctaattgctttactgagcaggctctgtagatatttaaaatcctgcctacaaagaagaataaaacagccttgcagagcatggaggctgcagcaagcgaacacacatggacaaagatgcccagagatggaaggctgtttcttctgcttacttgtattgttttttttttccctttggagtgagttaatttattattttaaagcatgcctactaacatctggcacttttagaaacatgccattctattacagtgtcttcctccaaagaaaaataatttcagtgatgccaagatcaagccggtgaattcttagcagagcttggtacttgctaggtgctcaataagtggtaggcaggctgagctgaatgatgagtcttttcaggagaaattctcaatgggtgaaaccctagaaagagagtaggagaggggacttgccagtctcctctaaccgcacacagaattcccagggcctggaaggaactcatagcctttgactttgcctgcaaagctattcattttatattggtctaaatttgggctgagtttgcagctatctgcaaccaagtgagtgaaatactgggtggtccatggagaaatgatggtattagaaacaggaccctcaagaacgtacacatgtacacatgccactgtcaccactttagagatggtaatagtgacactagggaagagagtagttgcttaaagactgcatgaacttgaacggatatttgtatagccaggttcatagcagcattattcccaatagccaaaaggtggaagcacctcaagtgtccactgacaggtgaatgaataaacaaaacatagatacctaaaatggaatattaatcagccttaaaacagaaggaaatcctaacacatactactacatggatgagccttgaagacattatgctaagtgaggtaagccagacacaaaagaacgtatattgtattattccacttgtatgaggtacttagagtggtcaaattcataaagatggaaagtagaatggcagttgccaggggctaggggtgaagggggttatcatttaatgcgtagtttcggtttgggaagatgaacaaattttgaagatggttggtagtgatagttgcacaataatgtgagtatacttaatgccactgaactacactaaaaatggttaaaatgataaattatttgttatgcatattttaccataattaagaaaaaaggttacactaattagtgacaactagactggaatgcaaatcccttgaataccagtctaacaatagaatggaaagatgtttggtctgggagtcagcaggcatggaatttagttcctttgtattagtcgaaggtcttcaacaaatcatgttagccctttgagccttgttttccatttataagagagggttgaacaacattccagctctgccagtcttacatacccagagcccttcctcagcccggggagtctcctagtggacattgtcctgaagccagcctggattttgctctctttatttttttttctttgtcacaggtcattcaggcaatgactgcatacctagactaggtgttgtcaggggaaaggagtgaaagagaagatggaagctttaaaggaactgttcatctctcccaaacttaatttcacaattcccaaagaggaaaagaaattaatgtatttgctgttaagaaattgccatatgtcctgttcttttatcccaatgtggatgatcattgactcccagaaatccctgagaaataaatcggagaatatgctgaaatttatttaattaaggtagtgcaggggctggttccatattaaacatggtgatggggatttaagataataatgctaccatcagtacatctaaaattgtttaatgttttactgcaaatattttttagctagaagaaattaaacaagtggggaagattctcagaaaccaacacagcccaaaatgtgcagataaagaaccaaaaaataacgtagaaaggagcaagattataataaatatttttaatgagttaatttatttcctctttttaagtcttaacttgtaacattatttgaaatcacagtaaatgtacattttatttcttgtttcagccctgaggtgagtttatttggaatgtttgttttaaatggatttagccatcatggaattaggtcatcttggaaaaatgtgttttttctaaaaaaaaaaaaaaaaaatagaatgatgttctgtgtgtttgagagtaatttagaaaccactgttaatttccagtcctgttatggactccttcttcaggaaggtaagtgcttttgatgtgtttgaagcattttgtgagacaagcaaaacaatttggagcaattgaaagtgacaaccctgccccgagcacatggcttcattttcattacgttataacgcaggtggaatgcagatcatgccgggtcagttctctctctcagtatcatttattctacctttctgtgccttaagagcaaacttttcacttaacacaaggatgctatccatttggcttcttttttgcttttccagtgaatagccatttgcttatcgacttgtttttgaacttactataataagctttagtcaattttcttttaaaataattttttggctttaactcttgtgagatagcaataacacaaaaaagacatttattttgctttgaaactagtgctttttccagaaggtcttgtatcccttaacaatttgcattcatccattcatcaaatgtggattgagggcaatgtactgttccaagcctcggattactatggagaagcataaggtgggttcatctctgcttaagatgagtttgttgtttcgttatgcagtcattcgtatggtgagaactgtcagtaattcatactatcttcaagtaaacacaaaaatccatcacgctagttactggtcatcctcttaggatagaagatggtgggggagatgagtatttattatctccacctgcctacaaagtgtttctcattccctgagttcattctacagagccatgatttgaacccaggtccttactactgcaatctggatactttccaattaccatgacatcttttggattatttagtctatcacttgtctgctttcactccccaccctcccacctgcaatccctgccccgtcttctctctttctctccctcccctcctacaatgagaaagtgatatataaggaagacaatgagacaaaagcctgaccctgaagtcagacagaccagagcttgactcccatctgtgctgggtgaccttggataagttatctaactttactaaaccccaggtgcctccactgaaaacagaagatactgatacttcagtaataataataagctctgacacttaaagaattctgtccaatgcctgacgtggagcaagcagtaagcctcagttagtgttaactgctattatgtttacgatcttcccatcataaatgctttatttatttattatttttttaaagtagcatttcccactaggttcccagcagagtggatggagaagcaggtgtggaggattggtttcaggagtctgtgtgtctatgagcagagaaagtataaatttatattgtgtctgaagaatttcttatgtgacttgattaaaaaaagataaggatgaaagcttaatgacaatatttttttttccttgagacaggattttgctgtcgaccaggctggcgtgcagtggtgtgatcatagctcgctactgcctcaaactcctggcccaagcaggagtagctggagctacaggctcaagccaccatacccagttaattttttaaaacaatttttgtagaattgggatctgtttatgttccccagcttggcctccaactcccgagctcaagctatcctcctccttcagcctcccaaagtattgggattataggtgtgagtcaccgtgcctggcttaatggtgataacttttttttgaaaagagccccaactgatacctagttgaaatgttacctataatgtgatattttctgggactctcccaggtggagttggtcactctagcctctgtgtcactgtagccactgttcgatagctatacacagtgaatgctcagtaatatttgttatgtggctgaatgagtgaaataataagtgaatgacaacacatcactttattttaaaatattttcacatttggttccctgatcagaccttgatatggttggatctggaaaggagtcttgtctctcccgttttccctgctgtcctgacatactttttcacacatagtgggcaatcagcaaagcttcccctattgctttttgtagactctttcctattagagacatgtctccaaacattcacagattttatttgactaaatactcacatgtagatctaattagttgggctctatttctctgttctctaaaagactccctgagtatttcagtctggagaccactcttctatctttttctccttccggagtttcagaattttcttcttaaactgccatctttgggagttcttctctgttcttcttcacattcttcccaccttctttccaacagtttttgcattttatcttaaacgatgtgtcttgaaaagatacaaaatgctccttctggccatctctgagccagttttactatgagccagagatcaacaaactgaactttttattttacatcttctgcatgccaggcactgagttaggctgtaaggatacagtggtaaacaagacagggttctgccgcatggaacttacactcctgtgaaggagcagtttcatgggttgtgaataagagtttcagagggataaatcaggaataagaagcagcctaacctagcctggggaatgggctgtgacaactgtgatgaggcctcagcacttgttcccactgggaatcaggaatggggaaacctatgcaaaaaaaaaggggcaagagaatgaaggctgtcatgctggaaaagctgaggccgaagctttagaaatgtttcctactttcagagttgggattgaattaaaggacaaagtgggagagaaatatgagcctaaaccacagaatcacagatcttttgccaggctcctggaataggggggcatcttttggatccataattaagtcactaccacaagattattgtcaattgttagtatttcatacattacagatgtttctaagtgattggtttcatggaaggggattgtggcagacgttgtttaaaaatatgacctctcacttgttccatttctgattttccacatagaacagatgatcttgattgtgtcatggtcaacccagaattatgacagtctgggaagattaggaggagaataaactgctacttaaaccttttctcagcagcattggaaagcatgtgtttccagcaataactcctgggaactatttggtcagtatatgcttcagctgtaattaaaagggcatttccttggttttaatttcttttaattaattaaaaaatatgccgtctgtgtagggggagttatagtcccttcctagatgtggaaaaatgtgatttctgagaccaaaaagcagtatttccaaaagagtgttctgaagaccactagttctgctcggtaacccagagaatggattggtttgagatttgctgctcactctgtcctcttggagattcacgagtttgtcaatgtactaaaggctctgagaagtcctgcagtaaagacacctctttaactcagcatttcacatatatgtttgagcaaagcacccgtttttaagcccagacatattacgattccacagaacacactttgggaaacatggtagtaatggtatttcttagcgtcctctgcatgcatcattgtggtaactctgagctgataggacttagaagcagtcatgcctcatgcagaagtcaaaggagaggcctcagccagatttagtggcagctccgattgtttattgagtgaaatgaacgtgtcagcagtagactgcagtggaaaaaacactgggcttggagtcagatggtcagaacctattcttggcctggcactaccagttttgctgccttgagtaaagaggttaacctcattgagcttctcttttctctgtaaaatggctattacctgccctacagctgccctaataaccatcattcattcagtgctccagagtccagaacaggggtcagcaaatgttttctgtaaaggactagaaggtgtaataaatatcttagactttacggcccatatggtctctgtcatggctactcacctctgccattgcggtgtggaagcagttgtagatgatatgcaaatgaataggtatagctgtgtcccagtaaaactttttttttttttttggagacggagtctcacgctgtcacccaggctggagtgcagtggcgcgacctcggctcactgcaacctccgcctcccggattcaagcaattctcctgcccgagcctcctgagtagctgggattacaggcatctgccaccacgcccggctagtttttgtatttttagtagagacggggtttcaccatgttggccaggctggtcttgaactcctgacctcaggtaatccccccgcctcagcctcccaaagtgctggaattataggtgtgagccaccatacccagccccagtaaaagtttatttataaaaacaacaagagagatttggcccacgggccatagcttgctaattcctgatctaacgtatgtcaaggtctttacctatattactgctaattctgcctgtaggattaacagaacacctagatttataccagagaaaactgagacacagagatgttaagtaacttgcttaaggcaatatagttaataagtaggtctaagaattgtgctcttagctaccatactgaactcccttctcttatgacatcaaaaaacaggttacaaattacaaaggtaaataaatgtagataggatgtagtattatctgaggaagttctcgtttacttgggctataggaggcaattcatgagaagaagcatgtattatatagtatgcttactatgcccttttgtctccactgccacttctgtactatgctttaccttctcctcactcagcaatgactggggtttctagggcaccgtaattcaaagaaattgcctttttctgaaaattaccaaaatccactagcagcctattgaacataatagtgacactgcaaatgtgcccgaaccttcagacattaaggtgccaggatgctgtagacttgagtgtgtaataggaaacatctgagtctacagttccagcaaatgtagactatttcttaataaaaaataaccctgtgtacatccacttaggttttacttcctaagtggagtaaaactagccctagagtcaagtttgaaattattttcataattttgggtaattaagacacttcccagatctcattagcaaatgcctaaaatagaataattgccatataattagtgactggcaaacttttagaggtttgaaggttttgttcttttctgaatttggaagtacaagggcctaatcttgaatttatcagaacccaggaaacttcgtaactagactccattcctttcccaattcatttgttttagtcctacctgtcttcttccaccaaattccacatctttctatgagtttcttgtaagcattttgtcttcttctatttagatatttctccttggctggagtcttgtactttaacaactatttagcatgttccttctctgagtctgacactgagccaaatgctaaggggaagatggtatctctgcctgctaggagcttatagtctagttaagatatgatttcatgataacagccaaagaagagatagggtggcagatgattcacttaagtctgctgtgctctgagatttagagttagggcatcctactcttctctagcactttaattgctttttagggctgcccttattatcttcattgatctcaaaataattctggcaggtagtacagataggatcgagaatagtaatgtctttcacctaaagaagctgaagctcagaagagtttggcaatttgtctaaggttatgcagttatgtatgggtttaaaaaataatagcaggtcttctgccccctggccccgcctattttttaccatgatgcatcagcacatggcacatagattcccaagtgtctcaccccattatcttgtcaagggaaagagtgtaaatgttgaagttggacaactttgcatccaaaacctagctcagccactttggtttgaccgttaggtcagtaatttaacttaaaccttcttattcctattcttcataggtaatttgagactgcaataagtcaattgcaggactgtggcagggattaactagaggacaaatgtgaaagtacctaataggataaatgaaataataaatggaagctcttataaatgagtatatcactccatgctcactcaccacacttcttctcaagtctctctcctttactggatcatgaactccttgagaaaaagagtcatttcttggtcatctctgacacatagtagggctcaatatactttgttcatttaataaacacctagcgcttatggtgtgtcaggcaccattctaagtgctttgcgtattttaactgagctttattataatcccttgaagtggaagaactactattatacccattatgcagattaggaaactgaggcccaggaagatatgccagagttcacccaactattaagtggtggaattaggactcaaacccaattgtctggctccagagtctatgctgttactcatcctgggctgctatcagttggactgggttaggttgttcaggccccatcagctttgcttcccccgagattcctgctccttggctctggaggcacattttgttaacaagtcgggattctttggtgaggtcagatttcttctatctgcctcccttttactgctcttgattttccagggttaataattcaagatgatagctgaaccataggactaaatttcaaagcacagagtctagaggtgttttaaatgaagagggaaggttgtgcaaaagtcaactgggtagaggaaggctggcgactagatttaggctagtattcagataagtgtggatccagaagagccccagctcagagtcatgcctaggtgacaagccaggtttttattctcctaacaggaaaggacttacttagaaacagagagtagccccttccaagtcttctttgccattctagggttgaaatttgatggggaaaatagaagctttcaggtctcacttaagagtcaatgacaacacaaggaaatctgtctcccagtccctttttcagcttctagttcagttaacatacttttacgtatttgcaaagatgtgtaagctgtttaatagaatcatagaaaaacctaaatgaacagggaatgggatgtattaaaacaaacacaagggagttaaaagaaaattcattctgagttgtgggtaggtaacttagtgtttaggtcccagttttttattgcatcctaatgcttgagcccagcgatgctgaggtaggcctggtgatgacaatattcattaaagttaatttcctgatagaggccacttaaatctgattgttgttttaatttgtttcactgctaatttccttcgcttaaatagaggaagctctctgcccctcccacagccagcccaggcagtttcagggaggtgacagccatcacggcattcaccaaccagagaatgccatcatgtcacactctttaggcaggagatgatgtctttatttatctctagaacctagaagttgcctgatttggaaaatataggtgctcactttcaaagtctaaaagtatattgctttattgaatatgaaatctcctccattactcagctagacctaaatccatctaggacttaatgggaaaaatgtgagtcccagcagtgtccaggatttttgaattatacatactcattttgttgtttgaagaacaaatataaatacagcacaggctaaaacatcaaagcaggagagaaaactcccacagtaataataatagcaaacaaaatgtttattaaattccaggctgttcaaagtctttttcatcatggaccttgtgcggtaggtgcttttgttatctgcatttttacagatgaggaagctgatgcctggagaggtaaatgaagctaacaacgaggatttgaattcaggagggttgccttagactctggctcttaaccccggcaacagtgcttcttaaactctggtcccaagactgcagcatctgcatctcttgagaccttgttagaagtgcaagttctttggctccatcctatagccacagaaccttggagtggcttcaagtgactgatgtctaaagtttgagaaacattgcattacaggatgctacttttccagacttggttcttacattccataaatatttatcaagtactcaataagtggcagggactattggagatacagcaaaagcaaaaatgcctcccctctggcggtttacagtttagagagtttacagactctaaagaaaattaagtaattcaaatactaaaatactaagctctcttatctcaggttggcagattacattctcagttagtaaaaaaaaaaaaaaaaaaaaaaaagatgctaaactttaacactaatagccagaggaaggaacaccgcataaaggagtttagaagcttacttcaggtgacactactgaggttgcaaacccaggtctcttggttcctgatcttagcatctctcctatgctatgctgagcatgttttcctcatctcctttgccctgtagcttgttagggggaaaaaaacatgaggtttatagacaggctgacctgagaccaaatcccagctctgccacttactgatttcattgcacacagattgacatgaggttggggtttgggggcagagttgacagtggttggtagaggcagagctggaaattccagtccacagttcctgccagctcacaaaactgggagagattccagtctagggaagggatgtgaatgatgggtggtcaggctttgttggtccagtgtctgtcactgctcttggactcacaaaacttcctgctcttcaactttgtgagattttgaaacacagttttctctccttctcactgcagtatgcttagccagagtcctcagaaggagcatagattttgtgtgtgtattagatatgcttccaaatgtatagccactgtgatcgagtgtcactgccactggttcagagttttctgtttcagggaaagccagtaaaaacctgacttttggaaatttccgtttattgaaaaaggcagacagcaccacttttgatagtgtgcttgttaaaaggctttaagaagaagatatttgactggctagcagacatttcacataagagatggtgtgtcaccagataaagagtagaggggactggggagaatgggataccatgcagttataacccactttccagagaacagaattctggtccctcgccttctaaaacactggcaaaataaggaagtaagaaatgtgttctttgcagaactaataactcagaaagcatacaaacaagggcctgttaggaatgcactcgcaaactatgctaattctggtttaactcatgattctgacacattgtcctggccccagagaaacttgggtagcaaatttgaaggagaagaagaaatattgaaactggggattctgaaggcaaccaaatctgagtttggatctcaactttaccagtcagatgcatgaccctaatcgagtgattaaacactgtggacctttcctcattcgatcgtctgtaaaactgaaaaaaaaaaattagcactttatatcttccagagttcttgtgaagctaatgcattgaaagtacccagcagataactgtacaattgtttcagtgatggtgaatagcaacaaaacggaaaggtatcacttactgagagcttcttatgtgccaggttgatctaagcatttcataggtatcaatttatttaaatatcactattattattggagttagactgtgttatctccgtgtactctggcaactaggaagagcttttaaatgtttttatgcagaactggaaatgcacaagcttgtattaatatgaaaattgtgatttaaattagaaaattctcaatatcttaaatgaaaattattgctccaggatgataaaccaggatgatctgtggatccagttgttacttcctgggggtaaacacaccatggtttgagaattacagccctgcactcctctttttatctcacctctgctgttcaggggctattgtggatgagctggtgatggtaagaggggcaagtgaggaagggatatgccccatgaccttgtctcttcccccttcccctgcgaattctggatccctgcccacctcctcttcagctcatcagtagtgacatgccaatgtggtaggcagcataatgaccctgccctaaagatgtccacatcctaatcccagaaatatgtgaatgttaccttacatggaagagaggattttgcaggtgtgattaaattaagggtcatgagatgggaagattatcttggattagtggagagggctcagtgtaatcacatgggtccccacaaccgggaggctggagggtcagagtgagagttgtggccacagaagcagaagtcagagtaatttagggccaggagccaaggaatgtgggaagcctctagaagctgtaaaaggcaaggaattagattctccctcagagcttccaaaagaaaccagccctgccaataccttggttttagtacagtgagactaattttggactcctgactttcagaactataagataataaatgtgggttgttttgttacagcagccataggaaaccaatatactaggatagagtaagcctagatttcctctgaaatgtgaacgaattttctatctatctctgttgcaaaagagagaaacttttatccctttgaaaatttcccactacagcttcagaataatcatgggcttgagacatgatagcgagggaccaatgtgagaaaagaaagcagtgacggggtggacctgccctttggataatgtttcctaaagtgacattcaaggagatcggcttccagggtttattctggcatggtagttaagcacatctccctgtgactttggaaatctttagcctctttttgcctcagtttcctcatctgtaaaataaggttaatcacagcattcacctcaaagagatgctgtgtgtaatgtttcatatagtacatgctacatggcaagctttatgtaaatgttagctcttatgaatagccattattttaaaaaagtgaaacagaatttatagggggtccaatatgtttagaacaggatccattacatcaaacaggcttcttttctgcagggtatctcagaatctttactatggtaatgttcactttataccttaaaattggagggaaaatgcaggaacatttctcaaacttatttaaccatagaaccctttctgatctgtaacaatctcagcaaatcagatttattggtcatagtatgagaaacactacccttaaaagttacaccaggaaaccttggttcacctctctccaactcatagtccctgtacccagcttctagagccatcaccgaactggagattggggacccccatcagaacagtgcaaggagaaacatgtgcctagtatcaaaagctgaagattagaggcttttttccacgttcacattgttctaacattgtatgttatcatatcagttagcttggctcctggggacttgcctgggaacctagcattgtttccataccatgacactttagctccaaccaggcaacctagaaatagtttagaatgtaattcacaagttggggacctgtactttagcttcaaagtaatgctgttgatttgtgagcagataacctagaaatatatacatcaaaatgtttattttactcttcaaataagcaattttcaaaaaagaattgtgtattttatagggtggaagtatagcatcactaagttgtattcattctagggcgtatgtttttaaaaaaaaactagtgtcattactttgcacaggcatgccttgtgtaaatataggaaatctaacttctggggaatttcatttcaagaaatcagacctggctcacataaagatacctttcaaaaatgaaatatagcaaatttagtcaagcttaggctgttttgttttgaaagctataaagaagtaaactataacctgctttatttttagcagacacctctagaaaaccttgcacaatgttctatttataaaacagagtctgttttcatgcaaagttgcttagtaataagagaaaagagcaagactgagtatcggaaaaatgaaatgtttctgttttcaagattccttgaattcatcagcatctctttaagacacaacaaagcaattgacctggttttagttttgactatgagaggttacctggagattgataaattggattttttttttttttttgagacagaatcctgctctatcccccatgctggagggcagtggcgcgatctcggctccttgaaacctctgcctcctgggttcaagcaattctcatgcttcagcctcccaagtagccaggattacaagtgcctgccaccacacagtttttgtatttttagtagaaatggggttttgccatactggccggactggtcttaaactcctgacctcaggtgatccacccaccttggcctcccaaagtgctggaattacaggcgtgagccaccgtgcccggctgaaaaaaagtggaatttgaaatgaaaatgcagtctgtcttttatgagttatgccactgagtaagcgacagaggacctaaataattatcaggtcatttcaatatcacattatatagaacatttataatttcatcatcctttaaggcattaacaaaaaaacaaaacaaaacagaaaacaacacagaagaaaacgtggttgagtaaattcaatggctatagaagattctagaaagtgaaagtaatgacccaatacaactagaatgtagtgtaggaaacaggcagtttccaccatctgctttatcattctgatcaattttgtatcatgctgtttcctaatctttacaataacaataaaaccaacatttatttaggggttattatgtgccatgcactctgctaggagctttatgtggattatttcatttaatgttcccaacaatgtgtcattgccatagataatataattatctccatcttacagattgggaaacagattcagagaggtgcagcagcttactcaagttcacacctttggaggtgttaaagctggttcagacacaggtctgacttcagagctgcactgttaagtgctacctagtgttaagtggagccaacagtgaaccaacagagaatacacacacgctgtgtgccagaggctcaatgtagagacagaggctggtctctagtctgcctttttatcgtaataatccaggaaagcttaggaatcccccccaacccgctgcaaaaaaagccccacatcatccatgacaaaaagaatagctttcctgtttttcttcacatttttcgcagccatttcttagcttcggaaaacttaggtgtgttcatctcaccttgcatatatatattgcatatattttatacacaattgtctgtttacctggctgcctcctcatcctctttcatctctaattctgatttttcctgaatacagaacctggtgggaagtcatagttctgcacatgtatgatgggtgaatggaagagcatgcccagatgcagattgaacatagacatggtgtgcagtgtatgctgtgggctggtttttctcaagcaacatgatgtcttaaggattttctgtgttgccacctagtcttcagaattaacatttgcataatatgtattttactggatattccaatcatggcaaattttttaaccattcttttttctgcagaatttagaaataattgttcccaatattttgttgttacgaattacactgtgtgaacaactctgtgcatagcatttttacttacttttggattatttcattaggatgtaatttctagacagggattactgaatcatagtataagcattatatatggcctgtgacagcattttccgatatgaatataacgtgaactacataggtaattttacattttctggtagccacattaaaaagtaaaaacataaaataaaatttggtttaatgatatattctatttgacccagttatcagaaagcaatcatttaaacatgtattcaatataaaagctattaaagtattttcacattcttttttttaatatgaagcatccaaaatatgatgtgtgtttcgcactcacagcacatctccgttttcagactagctacatctcgggtgctcagtaaatacggctatcatattgggcagcacaggcctgtgatatgtctaatccagtatttttaaatgacctttgctttttaaaagcccaatcttaatttgccttgccctttcctaacctcctccagttacacgtagtatctggctcattcccttgggcacttattttaagctgtcttgactttttcattgttatgaatattttcttgacctctattttgtgtcaggcactgtgctagatcttgggggacaccaagataaataggacatggtttgcaacccactgggagaagatagacatacccataacacaacgtggattcaaatgcttgtcggaatgagataggaaataattttgagaaaaaaagacacacacaagcaagttataatgcagagcatgacaaattccagaaatgaggattaaacaaagggctgaggggattggggaaagcttcttggggaaaatctaattatgaattgagccttgagggctcagtgaaattttaatgggcagagatatgggagaacagttttgcctgtgatgatcttgttatcccaaccagatggcaggttggtgaagagtggggcattgcctcacattgcatttagatctccccagagcgccctgccagagttttgcagtagaaggtgctcaataatgtttgttgagcccaattaataatatatggttggctggcacacagtgagggagacaccgggtctgtgtgcttgctttaacctctgaattgaagggcagtctaagctttttactcattcctctgattgtgtgtactgccagtttgcagtcacagttttctcactttactaaatcggtctggactgaaactagtcgtttagagccaaaatggtagataaatgggggctaacactttaacttacatctgacctccttgtcacttattccaattcccccgagctttcaaacagcacaaacaggccacagggacaagaaatgacatgggaattagaagacacttatcagaaggtgctttccttttatttgcaactcacacatataggcctttgtttgacaatcttgctagagccttaggaatttttgtcttcattccacaggtaaggagacaggaattcagagagggtacttattcaaggttatatagcaagtaaattggaaaagtcatgactagaacttctcttttctatctcccaagtgaacgtcttctttttattcgcagttggcccacccatatcaaatgtcatcttccattgctttgtgacagatctactcaattctttggtatccacatcctacatctgaaaagtagagaaaaggtaaacttggaggtcatatgaagtatggagaagataagttagggaacaaaaaccaaagggttggtgatattaatatctataatgatattaacattcataatgatgatgataagagtcaccatttaatttttaatctatataggcaggctgtctgctaaatgtattacatatattatcacatttaatctgcacaacatacgtgtatggttgctatttttatctccgttttatagatgagaaaactgagatcaaacagatgaacttgtccaaggtcatattgctaagtagaaagcagctggaatttgaatccagacctaacttctaaccctcttaacttaatcattgcactacaaagttctggttcatgccaacttagcttagatgaccttagacaagtcgctacaacttctatttattttttatttttagagacagccaaggctggagtgcagtggtgtatcagagctcactgcatcttcaaactcctgggctcaagggatcctcccacctcagcctctcaagtagctgggactacaatcatgagccaccatgcctggcccccaaaatcctatttatgtagactgtttttcccaaaattaatactttgctcacctcttggtaaactgataaatgtgagaattatttgtaagcagcaaagtggtatacagatatataatgttgtgtgcatttaaactgaaatttctcagtcagatgagagatatataccagcaacagagtgatgtctggcactaagcaggtgctcaataatgtggcttatattcattccatgaatgaatttaagacttcctttgctgaagatgcttttttattgccacatatggaaatgggtggtaaagagaaagaaggcaggccgtatgtcagcttcctgagcaaaagtccccacacccactaatttccctacccccttaatattctagggcattaatgggatgtagctagggaagaaaccaccttagaaaaagtagagtcgaagtagatgttgaattctccaaattcttccatccatgctccacttgcatttagccatctggagagttttacattgaataatttttcttccaaatgatatatagtcattatagaaaaagttaaataaaaaaagaaatagaaagggaaaaaaattcacatcacccataatctttcccctctcccttcacccccagagataacctaaccattaggcatgtccgtctgtttctttttcttcaaagcattttttacatgtttgaattcatactgatacacgaaaggtaatactttacttttccactgaccatcaaggaattttctcatgaacttacaaactcttcatgaacattcattcttaattcagctgacaaatacacatcttctctgtgccaggtgatggggacacagtagtgagccagactcattgagtttccaattgaccttatgtttaatggctgtatggtattttattgtccacttatcaattgtcccctttgggtctattttgcaggtagcaggctttcttgctagtaaaatgctccccaactgtatatccccttgataatgccctagaatattaaatagcatacaaaagaaaccagtattagcaacataaatgtgtgacaacacacacactcattgtaaatgaaatcaaacgtaataaaattgtgaattctcctgtatttgggggcagagatttcatcagttcctacttgtttattaacatcaattcttgagagttcgctatgtaacaagacaaaatccagctactcccgaacctacctttcctctttttcttattttgttgggaaatctaagttagaaaaacaatctacctgcctggttgccgtgacatgtctaaagggtaggatggggaagaggaggcacaggtattctctgtgagtttcctgagtacttggcagtcttcctacctcctcccctgtcctgttcgtcctgtgctctggagccagccaggcatgtgacacacgccacccttgcaggctcagtctctggtaggatgtgggtttttgtgtgttgtggtcctggtttcagctgcagggccttattatggaatgtataggaggaaacggaaggacctccctcccgctcacaccagtcctgtcacagatgccccaggtcacctcctggcctcagggcctgtctgcatttggaactgctggattaattttcacatcattctgatgttccccaagctcctctgaaattaggttatttaaaaaagaaggccaaagtttaaagacttctgtccagggcactgctacctatgaactggctggctatggatttgttctggaaactgtattcaatttcattttctcagcacctgccatgctagagcctggctcattataggcatccaggtgatgtctgttgaatgagtgtataccctgggaggtaccttactgagcccatcctcactgggctttcaatccagtaactgtgcacttcacaaagaaagggactgggacttattatccgggtctccctgtggtcaagcttagtgcctggcacctactgagcattcagaaaccttcttagataaaaaaaatgaattctgcatacccacacaatggcatatcattcagctgtaaaaaggaatgaatttctaacacatgctacagtatggaagaaccttgacaacattatgcagggtgaaataagccagacacaaaaggactattactatctgattccacttacatgaagtacctagaatcgttgaattcatagagacaaagtataatagtggttactagggactgggggagaaggaatggaggagttagtgttaaatgtgtatagaccttctatttaggatgatgacaagaatttggagatggatagtggtggtgaaagtaatcggaagtaatggcaaaaaccgcagttacttttgcaccaacctaatacttactgctactgaattatagcttaaaagtggttaaaatggtaaattttgtgttatgtatattttaccacaataaaaagactgccatgaaaaaaggaaaagagaagacaaatatcccttttctttacgtctacttctctccatctgttaagcctccctttttctttcaaacctggatgatgggaactgtgagattcctctttgaagaattctcactgctgaggattggacattagtgcaggtcccactgggggctgctaagttcaccgcgtttcctctcctcagggtcccagggctgagcaggaccagcccttgttttaactgaaggcaccctggtaccttgtcctttgatttctgcagcagcaaaacaaagagccacttatgtaagcaccaagtcatgtccaaaatctgcctcacctgtccaccaagacagaagtcctgccatgatctttcctctgcctcgtcaggctctctttgcatgatggatgggcgtcatgtttcttacagccatgtagaaggaaacagattgaaaatattccccttcctgctatgaacttgtttacaagattaaaggcaggtatgcttgagagggctgggcggacactataagattatttttaataattcagagcacgccaagttcgaaaactggtcatgttgtcttttgtttcttggtttctacagtaaactctgcttacaccacctcctttccagcagaggaaaagaaaatcggtaacagaggcttaatgctgacacttgttctttattagttacaaaaaagggacacagcgggtgtgtttgtaaagatgtccacgtgtgctgcctgggtttaagaagcccccatgagtagctcatggggctcaggtgaccacctcaggcacaatttgttcctttcctgtccatgacacacagaccacattattcacccaggcctgccctttatcaaaacaatatctcttttcatcccaaggatctcataacgaaagaccaagctacaaagtcgtagtgaagagatgggatcagacagctggtgagagagaagccagcactaccctttggaggcagctgggctggtggtttgggctagccaggcttcccaagcagctgcaaaggggtggaaatcttgccctgatgttaagttttccttccctctcctagcgatgtcaattggtgtgtgtgtgtctctttgctgcacaaggtgtgaagttgctctgtgggctaatgcaagacatcttttgaattgtgcagaagaggaacttccaggctgcccagaggagggacttgggagttgggggtggggtggtacatggccttcctaaacaaaatccagagctaagaagggaaaacgaggcagggaggggagggagcaggggccaggtgtctgcctttcatctggatattcaagatgacacatctggtgccaggaaaactgctatttctaactgacggggaagctttgcagtcaagggagggctgagctgtcaggtgagctagagatcaagaattatcatgacagcttcatggcatgtgaaaggcgctgtgaagtgcagtatgattttaaccagcggtggttaaattagcttctcttggacctggtgtgatgtgcagtcggagaggggccgatggcggctgggagtgccaggcgtgaagaaggttgcaattcagaagggctaccatttagaaaagaaagcgtatgtgaaaattggctcccggtttctgagttttgcttaatagaggtgccaggcagcagtgatggcattaattagtagcttgtcaattccttcggtgaacctctcttcaccccctattataaatattccaaggacccaaagtaaccgcttgtctgaacttccccaatttaagatcttgtcaaaatctgaccacctgtactagctggctaagcagccttgactaaccgttttgccctgtgctcttgcattccacaggattgtccatgcaagactgagccagtgagggagcgagcaagtgagcgagtgagcgaatggctttctgaaaaacttccactcaaaagtgaactgaggaagtaccttttaataagtaatcagccagaggaaatcaggctctgtctagccatctagaaatgcttgcctatgcattggggactttcaaaagtctggagcaggagggtctatgatttgatggaccatggcttgggaaattctaggaagaaaaaaataatgtgagcaattctctctgtgtatgtatatatgtacacacacatacatgtatgtgttaatatatatcatatgtaaattaaaagctgtacattaaccctctgtgccaaaaattttacaaaagttcattcactttatccacataggcaaacattctgtttttatttgtaaaaactgaagtccagagaagccaataattggccagtctggaacttgaacttgggtctgtttgactccataatccatgctcttaaccgttgccttcaaaataagaatggctaacttttaaagagcctgcaggtgctcgttacgctaactggcacagccaacctgccagctcctaaagtctgggtgctatgtgatctttgcactttccccttcacagcttctgtgccaaatccgagcacagctgccccaaggcttccaagctgtaatccctgcagaaggtgcccagaagactatagtaataagaacccaagtctttttgatgcagccagctcaggacctgtctgtgcattgaaaatttgtggacgttgatttgtaacaccagggctgtgaccctgagtagcccacctgaggataacaggcaccaacttcctgtttccaaatcctgctttcctaggacgcacccagcccccactgaagtttgtgggggagtaaattgctattcacctgtccaagcctccctggatttatggcttggcacctcccttctgcctgcaccaccgtactgtgtactgcaaacacagatgaccttttcagcgatttcgtcctaacttgcttccataaagaaaacctgttttgtattgacattgtttggagtaagttctgcctatgttaactcccttagcccctgcccctggaatttcagcccagggaggccaagtgcttacaatttcaagagcaagggggagggtgctttgaaagcatccccagcttccatccatctgagtctttggtccagtggcttcaggcagatggagttgctctccttccttctagttttctaatctctccctagaaggggagaggttgcaggctcaaattggcccactggcaatagggtgctttgtgggacatttttttacaagttggttcccatgtggtatttgttagtcacagctaattattaagtcctttggctgaagcaatagacattgttcccttggattccctcctcctcctttcccccctcacccccattgctacacaacaaaacccattgtggggctctggaggttggctgtgcacgtattttccagtgaacccctgatgggctcactgctggggtttcatgtttcaggttgaaactcaactggataaagcattattcattggcactgacacattcagtgttctgctctgtgtagatatttctctcacactagacttggtccctcacaagcagtttaggtaattcactgagagcaattcactgcagttactcagaacatggataatctgcacagaactataaaatattaggatttttagatatggaaagatcatcaagtgccagctttggccagctgtgttcagaggtgcaggttggaaaggaggagggagctgagtgagtaagcaggctccaagttccttcttcccagtccccacctttgcatttgcctgctttgtgcattgcatttctgcgtaagatttctacaacctaaaagcaatcttgaaatccagtaattgagtccactctcattcattgctcaggtgaggaaactgaaccagtgaggaccttttgctaacctaaggttcaggtgagccagtgaattaatttcagcatgagaattagcacacacatctccccacttctgtatgccccatttgttatgccacgctgagataattctggaatccatcagtgggctgctttttccattgcctgccactgtcttgtggaaagaccttacctagaggatttagaggactggaaagcccccagaacagccatatcatactatgtttttactaaaggccacctcggttgcacaattccatggcacctcttggagctgtacagtacacagactaagattctgtatggagcagccttacttttactttacatatatgagagcaaaaactgaaattgtgctagtaggttttggtcagcattgtgcaagggaagaacccaggctttggagccagcagatctgggttcagatcttggctctactacttactggtcctgggaacatggacaagttacttgatatccctgatattcaggtttttaactaaaaatagagctgataatacctaccttaaaaattgctgtgaagaactaaatccaataacttacgtaaaagctctaggtaaaagcacatcaaggccatgataaatgttttttttttttttcctggaatataactgctcttcttctcatacacatatggatctgagttgaaataaaagacagacattgttaaacttcatccttaacttggaaacttctggattttgtcacagcttaacattaaccaaatgaaattttgggtctctataaatatagaccataggtttgtcttatcttttacagagcacttataaaactgaggatttcctgggggaatatggctgtggggttttaagagaaaattctgcaagggaaaacaggaaagactgaaaaatttaagccctgttcctttgcctctggaagcccctgggtgtcctgtgggttcagagattcactatcctcgctgacagcaaaatcagatctcctcgttgtaacaactacctgagtgtgcttgagacttgttaaaatccttctttattagacgtccagatgagaaccataggcccagaagcttgttttcaaaatctagcaaaacagatgcttttgcttgtttttctctgtctctctttgtccaaaatgctcactgagttttcattgggtttcgaagttgcctttttgttttgtttttacttttaaaacaaaccttagaagagggtcactgtaaaataaaggggaaggatgggcatcccaaatgagaaaagctgtattttagactctaataaaaatgtttaagaacctgaaggtgaggaatcttaaaggacaagagagagaaagactgattctttgaactctagaagggtctacctggcattatccccaggcctccaatgccaggtgcctcccaagcaaattgaggtaggaaagagagcactaccttctcctctctaaaagcactgcatctagctgagcaaggcggtgtggctgtgttgactgaccatgtgccatatgtcagctgaggcccagggccactcccaggtccctgcattttataggcagctcagacgttgtaggtactgtaccaattttctatttctgctctatcaagtcacagcaactttagtagcttctaacaacacatatttatcttacaagtacgttggtcagaagtctgacatgggtctcactggactaaaatccaggtgtcagcagggctgcatttttttggaggctctataggaagatctgggtttttcgtaacttttccagcttctacaggttgcccacgtttgttgcctcctagtctccttcttctgtgttcaaagccatcaatagcaggttgagtccttctcacattgcatcactctgatcttcttttctacctccctcttccagttttagggacccttggggttacactgggccgacctagataatccaggataatcttactattttcaggtcatctgaattccatcagtgactttaatttccccttgccgtgtacagtaacattcacaggttccaggtattaggatgtagacatcttggagtggaggagacattattgcttaccccaggtacatacaatgattgtatatattaggactttttaagtttcaagaaacaggatctaactaaagttaataaaaagaacaagattttattggcccttagaaggaaaagttcagttggcttcaggtacagctggatgcacatgttcaacaacatcattacagtcctctcttttttgtcttgggtttctttgtggtggtttctcaagcaggggctatctataggacagataaaatagctccctggcaattccaggctcatataagtcttaagattcaggatcccagagagaaaaccctgacctcttcttagatagcaccagccaaatcctgagggtgactctcattgacacaacttgggtcatatgtacatccctaagactcattctagaacagggatggaatcagtcttaccagaagcacatgtactgagtgggaaagggagtggttctccaaaagaaactcagatgttgtcaccaaaagacggaggaaagatctgaacagacaaaagcaacaggtatccactccactatgttattactggatttcagaaccatgaaattgatatattattccagttcagagctcactaggcttcaagcaacaagatactcaagcttgaaagagtacagaagagtctcacccagagcaaggagtaaattaattcagatagtatataagaagaggaattatatggtggcaaacattgtttttggaaccagactgcctgggtttatatccaagttattaattgtgtttacctaacctctctgtgcctcagtttcctcattgtaaagtagagatgataatagtgcccacctcatgagtttgctgcgaggcttaaatgagttaatacaaataaagggcttagaatagtaccttgacacagaaaaagcattaaataacacaatataattattctcctcatattcttatttctattataagcaagcaccccgggcatggcttaaggacttggaaagtggttaggaagcaagtctgatactttcctagtttctccttttctggctagggctacacagtctcttctctctggaactttctccaccatatcagcgtgaactgaggtttgcacgtatgccacagatttttgcatggctttcaatgaccattcttctcgctctggtcttgactatacatgtccaccaccaaatgaaagctgtgtcagtgtttctaaattcaaattcttgaaagaatctgattagtctggccagtgactggctttaagtaagtgtgcactccatttgattagctgtgattgacaaggttagggtcactttatacacaggtttacctctttcatttggcatggaaggggcaggttaaactgaaagggtaagttgggcttggccagaaaattgaccgacttgtctgttacatgtatgccttagcaaattagaatttacccacagaacaaaatagaacagttttaaagaatactgataagatctagatgtttgggaataggataacactgggaactacttagttctaatgtgatttagcctgtagtatttgcagagagaaattgatcagtctcccattacttgtatcttaaatggtagagacattttcagcaccgatcagaaatgctcaatggatggacaaagactcattcccttctacatggaacatcaatctcaaaaactcattcttggagcagaagttcctgggatggaaaaaggctcatgttcattgtcaggagagtggattccagagtgaccagggatgtccccaaatcttccctttggtggcagaagaaaagttctgtgtttactttctgtttactgtgttccttctcacttttcagagcccccgtattttttcagaaatctcactccagggtattcaaaccatcttaatggacagagtgcctgtgtcagagccctcatccttttctccaaggactttagtgagaatctttctggaaaagtagaaagattttctcctccctcctcactcctcccctcacagtgattgtgagggagaaggagtactgcagaatttcttagctgtgagatgctacaggaagggtggaaatgctttggatcggggctgggtatcttaggaagcactgagatttaggggaagacaaagcattgtcaagattttgatagaggcctgctgggaaagtctccactgtaaaggctcttgtgcccctttctagtggaacaattcgtaggctccacgcttactttcaaatggattggttttgaagcagtcaacaaaaaagcatcctgctgccagggccaaccatcaaaaagagaaaagagagcaatgcaaaccgtgggggaatgtgcgagagagaaatattgcagagcggagccgtggctctgctggcctgataccatgtgcattatctcccccaaaggaccccgtggtttaatggatggggctttaacctacccagaggtcagtctctgctggacaagtggaacctcatccctgagggcattgacatactcatgacacatggacctcctctaggtaagtgaagcaaaggttgtcctttgtcatccagatgcctttttttccaggcataatgaataatgcttcagggacataatcattttcctccaaaaaaaaaaaaaaagtgaatacgagaagaaaagtcaatgtctttaaagaaactcagtatgataattaaactcagcagttctgctgggcttacaggtgttcttgaaattaaattttttgatttagtcaagtcagggaaaaatcaaatgagtatggtgtgccacagtcttctgagcttgataatttattttaagaactgtattcactttggagtaagggggtggggtggagaaaggaaggaagattcggacctcccaatcacagggcttttgaatggcaatgaaatgatggaaatttttattcaaaggagctcattttccttttccatataatgctggaacctggaagacctttaaagtttaacatttgagctgataattttagaaaagaatcctttttataagctgaggtatttcagtaagaacttacactgaaagttacttaaggatacttaccctacaggcacatggaggctgcatccagatttatattgtctgtgtgcttcaaagcctacccactagtgagccacattatgggccaaagaatgatcagttgacttattaccttttaatttttcacgaacttgttatctgttggtttagctacagaacatccttcaacaaggactaccgccctgatcccacatctactcagtacccattatgccaggaccctttctaaatgactaaggtgtgctcaagaaattcagatgtttcacttttaatagaagactgttcgattttttctttctttttaaaattgtggctaaacacacacacatacacacatataacatgaaatctacccttttaacacatttttcagtgtacaatgctaaaagagtttcttaatcatcttggtttggagagagggaaaaaacactttatacaaatataaataatttccacaaattttcctgtggtttggagtttttatccatgttacccccctcctttgccatccctaaaaataaaaagaaaaaaaaataacattcatttcctaatgcaagtttaatttttgtagatattttctcctccaaggcacttggtgctgctctccttctcttacaagggaagtggcccatgtttcacaaagaaacagtggaagtgagcaccatggcggaggccatagtggcacattttagtgatgggggaagcaagaaaagaagagccagctctgttgcagacatgggaattatatagatttgcacaggatcagcagttcctgacttcttttaacacttcagaatcaccattcccatgctttttcatcatccccagaccacctcaacccatgttttaaaatattacacttgtcaacaacctttatcaagtcataattaactaagttccctattttacaaccattagagtagctacatcattaaattgctagctaaatattgtgatcagcatgagttacccagtgagagcatcctacagagttatcatttcagctaccttcatccttttgcctgagcagcctaattgggtgcaggcatgatttccctttggctatttatttcaagggacttggacatcttcagcagagaaacatttacatgactcgagtattatttggaatacaactttgaacagaacaaacttatcaagtcattgattttggtataaaagcaaatggcaataagagtaagtctgaattgtagactccaaggatttcagacatcccaggaactcttaatagggaagctagcatccctctctttatggtaaaggtggagtaaatgagagagtggctgtgagtagagcagagtgacagctacatcaaggagttcccaaataaaaggtcaggcaaagtcttcctaaggtattgttaaaccttagttaatatagctattgggattcttgtgaaaacgtgacattggagaggggagtggagagactggccttgaatttcttcctgctggtgagggatgccacagtgccgtgagacttcactgttatggtataagcaagatgctttctcagatgtttgcatatgaaatggaatattttcccccttcaggaaaaacacatgcatgaggtaatatgccaatcaatgtagcttaagaattctgccccactattaaaaaagttttgaaaacgctggatagatttttgctggggaccccactttcatctattttcagactctctagtcactccttaaaccccagcgaatatgtctttacagagacactaaacgttcatgtctgcagtttggcccgaaaaagcagaaagctgttccttactgcccagttatttctaaataatagaaataacctaatggcgctgtggaatgggtttccagagattacgatttagcctttcatcctacctgccttctttatgccctatcctgctgaggcgtatggattccattccaggccataatcatccagatagctgacttttgctataattgatgtcagtttttatggattttctgcattaagtgtagaactaagtggcttttactttaaaagtagtcaattagccccagcttgctggatgccactgtgaggtcacatttttgcctgtcgctggagaggacaggaccacaggagcaacctagctttccaaagctttggtcatccggaaccacaaggggtaagacttagtgtatctaaagagagctgggtatcttgtgaccagtttacaggcagctcctctcagtccttctttgaatcatcttagaagtaaactgctataagaaagatataataaaatagcgaaagtaactgaattgagggagaaagagatattatgggactgccgggaataaatgtcattgagctcatgaagaagatttgaaacccatggctgaataaatcaaatctcctacagaaaaaaaaatgttaattaacaggaagaaaaaaaaatggaaaccaaaaaaaaatttcaagaacctaaagaagacaaagtgacgagtgaaaagtttcttaaaagccattgtgagctttaatggagaggctaggattacagataatgtaataaaccttctgtgagttatggcttcctgaaagtctaaatgaaaccttacctgaagaaagaaaattaagtgtattgattgcattttgcccttaggttttcgagactgggttccaaaggagcttcaaagagtgggctgtgtggagctgttaaacacggttcagaggcgagtccggcccaagctccatgtgtttggtggaatccatgaaggtaagaacagcggaaaagaattcaaaacattttgtgcccctgtccactatctcagtctacaactaggaataagtggagtagttgttttcaaactttttagcagcgggacccttttataagatgaagtcttatgagaaacatctgaatataaagctgataaatattttatatggaccttctctcttgtaaacagagtggaaagtaggaagcacgtctggtctactaactgcaaaccctgcactccccctggcagcttctggaatctcagggctttaacgaggaatgtttgataaccactgctttagagcaaccccaaggtatacaaggagtcattttctccttaagagagttagaagaaatggtctggatattagaagctattttaagcctctatagtcccctcctacctgtaaatattgtgtttcatatggaattaacacaaagacccaggaagacaaggcattctctgaaaaatagcttaggacatgcaatgaaagatatgtaacagaagtggcgggaacctgcacatttgcaggtagacttttccttactaacctcagaaaactatttcagacttctcagaaatcatcggagctattagctcaggctgaggttaagcagaataattaaatctctcttaaataggaactggtccagttgccatttttctgcctttcaaggtaagctgagtcaggttcacagaaccgaaagcctaacaggaatcttcaagggatctgggttttctccgacctgcctttttcaaatcatgggtaactgggctttgagacagacacaaagccctctttcagcaagcctaaggatttctgtccctagcagattttcccagttacacacgcttgtgtgcaatggccgtgtttacgtgggcagccgctatattctctctagctcctgcttatggcagctctctggagttacttatgaatatgcagtcaagttgaggtgtttaaggctgtgtgcctgaggaagcaaaaaacaaagtttgctttttcaaagcccacaaattcagtggcttcctggttaggtgggtaataaagagcatattgaaaatcatcctactgaggccagagaaaattcagtttgctccaagggcaggtaccagctgagtgggtggaaagcagggtgcagctcccagagagtggatatcggcctgccctggctttgagctatgctccctgaaaaggagggtactgccctaaggtatgatggagggaacaccagtgatgggggaatgcctggaggggagactagggaggtgggacctcatatctaaactaagcaacatttctggaggactgttattctgaaaacaggtctgaattcgtgcagcatgcctatgagtttgcattttatctttgaaaaaaatcattaattacctttaaactagccagacaattggggaattccactgaagccccaaaataataaacttgcctaaaagggaggagatcatattcatataaacttgtctcacttttattcacttaagacagctgaagagggcaggaagagggcaaataccaacctcttgatggagagagataacaagactttatgaccccagaactaaacagcgcagattttaaatgcctcttttcttttcttaagagatttttccattgaccctcattaagttctccacaggctttacttggagaaattttagccaatgtggaaaaaagccttttcagttacttctctatatcttggtaattttatttttttcacagctatgtttttatatgcgataagagcctgataccaacatagaatcttagttgaagaggctataaggcaaatataaggtattcagggaaatgtgccaacttgcaaacatgctaaacattttatcatattgaaaattatcaaaggaacatatataccaaagacctagggaaacaactttctcccaataaatcacaaaaggtttatattgcatatgggaagtgtttttgcttgatctagtatccaggtaagcttaggaaacagtgacctagggtgatgtttctacacatcacttcgacatgtgattagctgacacttttgaatgaaatggaacttagtattaaagccacacaattcaaaaatcatatatggttgactttcgtaaaggcagttaagagattatttcataaataagtaaattgagtgtctacatttcttaactctcaatgcagtatcctttcccccctcacctgccccatatcccacttggaatttagttgtgtttgcccctgaggagtaatccttatattactcattttattccctagaactcaatagttaacacaaggctttgaaatgaaaatcctattttaaaaggaggaaaaaagtttttctttattctccctagtaaagaaatcacagcccttcttcaacaagtttagcatttaaataaagaaaaaaaaattgctcttagttgaaggagaagattctaccatttaaagaaaatagagtaaaattgggcagtagcttctgaaagtcattatatctgaggaggctcaactgaatttcatctcactgcccactgacaaaaattttttgttttccttgcctgacagccctacattccatcactctcatttgtatatattacagtaaatgtgacacgctctccccacaggttatggcatcatgaccgacggttacacaacgtacatcaatgcctcgacgtgtacagtcagctttcaaccgaccaaccctccaattatatttgaccttccaaacccacagggttcctgaagctctaaatgccctattggaatgtgagggaaggtctataaactgccatttttctaattataaacttacattctcttacttatttacaaaccctgtgagttctttttgtaaattgttggaacacaaatgatgctagaggttgtgcttcttattttattttattttaaatggggcatccatttgaaatcagaggaacattgtgaatttgtaaaatgacttctgttttctcaaaggccatgccattgtaaattgttagtgttcgccaaaggacagccaagctttcttttaaaaagtgataaaagtcttattttaatatgctttaagctgaaagaaaaaaaaataagaaacaggcagtgttttaaaaaccaacacagatttgcacaactgtttaagagtattgtttgaaatattttaattttcaatgttttgttgttgttgttttcttggtaatgcttcttttttgcagatgtggtcccaatttatagcaatcttctcaacagaagtaggcatggaaaagacttcttttcatactctcactataaagaaagctgcattgagaagaaaatggctgtcatttaaaggatggtttaactagtgagattcctattgtggttatacaaggtctcattgtttgtttgtttcttttaaattatttcagctttaaaaatacagaaatggaatctgtcaagagcaggtatttcatacggttaaaaaaatgaacatgcagactccttttcaatatgggtttatatatataagtattttttgtgtattatgactacgttaggagtttattattgtcaaggacagtacaactgcaaagggatgctgtatagcaacacatcagaagtcggaaggaactgacacattctctcagagctcaaggtcttaaagagcttgagttaaatctaggtacagttacaggcatgtatagacttaaatggatgcaatggaagctaactaaaataaggcttagttgtcctttctatttaaataccccaagttgtcttcttacttcctctcccctctcccattttgcactgtgtgtcgatgcaatcttcgctagcacaaaatattgtcgctaatagtcatttctgttttcccattgtaaatgctgttgagctttattctattttatgttactttgttaatgaaatttaggaaagcagttgtttctttaaatttattgtgatattctatatctagcggcctttatatgcaaataaaattgcaagatttttaaattcgtgctgtttagagggttggatggtggaggatggtagtttcgtcctggggaaggagggatttattcatatgcaacatcagtaatgcctttcagaagaattagaataagtgatttttttccctaattttcaataaatttttattacccaccattcacaggctggcagatagatcgataaggcactcagtgtactctttccttccatcatgctgtcatctgtcttgccttaggtttcatctttggctgttgtaatttctacaggaacagagagactggagttaaggctgtggatttattttgggcaagtttgtgatagtgagtttggggaaaccgttgatgacagagtaatcactgcacattctcattttccccaagagcagtcaccatctcctcctcacttttgtaatgatgcccacccacaaaatgctgtggcaaccaagaggggatagcagaagggtggcgaaaaccagagaaaataaaaaagacatcacccagaagaaccactgaagcaaaacagcataatcttggatctgcagtgcaccctcaaagtcttatgtgtcagggctcattggattgtattctggatatatgttccttcctccctacctattgtggatcctttggcgcaatttctgaaaggtgttcttgatttcagtaccagcagaattgacagaatgttctaagccagaattcctgctcagagtcacatgtaaccatcttggtctgttgtagttgttaatagttattaagtatcttggatgtcaccataggctgtgttggacatttgggtccaagcttgcagagcagatgcttgagcttcccatgggcttcccagagggagctcatgactgttgcagctaacatggaccgaaagaggtgctatgacaagtggacaacacttccttgaccttctacatcagtagaagagggtgttcacttcaagccccatcctagggggttggagtgagaggtacactactgaatggaaatttcacctggttagtgtactagaagccagagactcaggcctctggcttctggaaaaacaagcctcccagagataggtgggtaatcacgatcacaagtatgtatgcccagcccttgagagtacgtctgggcacaaactaattgagctaagcacttactaaaattgctttccattttgtggaggcaggaagctacccagtgtactaaaactagaaggcagactcatttgtggataaagctttcttcagccagtccaccatttcatatgcacgagctgcctctgagggatttgtaagcactgtccagatgcccagagctttctacactgggccttacaacaacaaaatattcaaaacagctcttacaaattgggcacttcctatccgtccatcaccaggcaccctgttgaacaggttgtgtattttgttactaatcttcacagaatcctgcgtaaggtcacataagcctcgctttacagataggaaagtaagatgtaccaaaattaaataactttccctaggaaaaatggaaggttcaaaagcagatctgtccatagcccatgcccttttaatcattctttgtctggactggataagttgatggatgccctctgagagctgatataagacaggcacggtggctcacacctgtaatcccagcactttgggaggctgaggcgggcggatcacaaggtcaagagattgagaccatcctgaccaacatggtgaaaccccgtctctactaaaaatacaaaaattagctgggcgtggtggcacatgcctgtaatcccagctactcctaaggctgaggtaggagaatcacttgaacccaggaggcagaggttgcagtgagcgccgagagagtgccattgcactccagcctgggagatgagcaaaactctgtcagaaaaaaaagagagactggcacaagcctggggatatatcctatccctcaagtagcagctcgctgaaacaccctgcaatgtggctctttgacagccgtacatggcacctcatcctctcagctgaggcccagcacagcacaggggataagagcactgacccttgggacagtgtggctgcccacatactggccccacctcggactagtgctgatttctttgcctgggtactcactttctatgtaaaacgggggtgatgaggaggaggaagttgttctaagtgccatatgagttcattgttggagatcactgtctgacatctagtaagtggtgcacatgtatttgttaaataaggtcacccatgctttgtctttagattccccaggcaggattctgtacctttttaaaaaaatatatttaattttatttacttatttatttatttatttatttacttatttatttgacagagtctcgctttgccacccagtctggagtgcagcggtgcaatcccagctcactgcaacctccgccttctgggctcaagcaattctcctgccttagcctcctgagtagctgcgactgcaggctcgtgccaccgcgcccagctaattttgtaatttttgtagagacaggatttccccatgttgcccaggacagtctccagctcctgagctcaggtgacccgcctgcctcggcctcccaaagttctgggattactggcctgagccaccgtccctggccttcagtcagggttctgtctgttgactctccaacctcgaaagcagcagcggtattgtttctgagaaagtttgtttgcattgcttaggaaccgtaacaagcctctcttcataaggataggaagaagcccaagggcattagtgggaggcggataagggagcctaacttcccagtttggctatcattctttgcaaaatcacttctaatctccaaagaggagggggtttctcctctttcaagttgcttagaagggcacccacagatctgcttatttctcacagcatctctctgcccttgcaatctttcctctccacctcaccatccacttttagtgcaattagtgaattcttttctgtttttcacacaatccccttttgtcttatgttgggaggttgctgaaatccctttagaaacaggtcactgttattctgacaggtggccagccttaagcctgccttcatctccatcatttaagtaaataaataccgtgacctaggtcttaagtagggagaaacggaagctgggaggatttgggatttgtcaattgcagataaaacacttgctgtgtctcagaataatgccccattccccactctcatccagcaaggatgtgcagctttggcagaatcaacatccagatattattttgcttcctagtctcttttcatgctctattcccactttcctgaaagttttaagatgctttctgtgtaattattaaacaaaagtgaattaagatctacttttaaggatttggccatgaggtgaggcatttggaaacactgctaggtatggggtaggaacaattgcttgtggggaaggttccaggatgggatggtcctaatgtgtggtttcacggaaggccccaggaccacttctggatgtcaggttcttagcacaaaacatttttgttgttgtttgcttctgtgtttgtttgtttgttttattttgttttctcctatcttgcattcaatagcaggatgtgtcggccttctagcatggctcttccagaagtttagagctacttttccctcccttttctaagtgtcccctctaccttcctcctcttactttgcttttccatgggagagaaaaacactgattcagaaaactccctaagaagctccaatcttccctggtgccccagtaaagtcagcctctggagatcaggagaggttcagagaggatcagtggtatcaccatggtcacagagcaattcaaagataatgccccactttggcatttggacattccattttgagcatgaactgatttttcagcttgacattcagaaataatcaaagatggagagatcagttttggcctgacatagtgtgattttgtagcacaggaccagctgccaatctgtgaagagaaaacaagattatttgaaagaaacctcagaatctgaggtttcccatgaatgttcccatgaggattcattttccttttcttcaacccgtccacctgcaacaattccaataggcttccaattcctccttctacaagagagatgggtgctcagtttctaccttttctacctcagaacatgatggctgtttgtcatgcgttttgacatacatgtgtatgtcaggtctggaagctgttgggtgttggtaagagcccccaactttggaatcagacatgctgggtagccttggatgtgctcttttatttctctcagcctcagattccacacttgtagaaaaggaatcattcccatctcacagtggatttgtcagaattgatacattaatatcgacaggaccctgggtggaggatttttattctgtcaattgtaatttcctaaagagaaaaaaaagaaaaaaaggcaggggcagagggcaaaaataaaaatgtatattattttctgatggccacagcccgtcacgagagaaagctaattccttgaactggactgtgtaagaaaccatacagaaaatgagttctttaactttctctctctctgaactatctgacaaaacatttgtggtgggtttttgtcgactcctcctcatttccttcctgaattagggttgccttacaagacaaaaatcttgaggtgaaaaggctctttcatatctgacagcatctatatctggataatggtgagagagagaaatgcatttccattaggaagcacagccacagtggaactaaaagcatgggtagactaaacacatgaacacagagagcctcctcccatcaatcagctttgatttttatgaagccatagttaccatgaggtgcatctgaacactcccagagcctgcttgccatggggaaagggcctgtgatttcatagcccatttctgtcccaaccttagttgatgactttgggaataggttgagcttttcagttgaagatcctgaaatcacaaatgacttgaacccaaatgctccctgtttgcatgggctcaccaccatgccttttgtataaatgggctatcatgtttaggtagcaactacataatcctaaaaggaactcctattttctggaagccttttctggatcccccaacctaccttgacccagaacacccccctttggtgctgccatagcctcccacatatacgtccagctgtgccacgttctgattgttgcgtgtctgcatatgagctccccaaggtcagagaccatgccttctatctgcattcccagcatctaggtctgaagaaacaccttcttaatgaattaatcactatttggcaaataacagctaggtatgcgagaaaaataggcaaaatcaatcacagatgaaatcaacaaatatttactgaacaccataagccaggtgctgtgctagtaagcttcatttgtaagacccagtatttaccatgaaagagtctttataactagatgaagaaaacaagatattgacacatgaaggtaaatggtaataaaagatgtaaataatagttaagacaacaataaaagaaagttggggtctggaatacacaggtttctccagttacatgagtggccatagatatggggacgtgcgaggtgtggcataaaactcagacaagcacaggcagctagcctaggaaagggagtctgcctgctaatggcagtgtcaatcccaagtagcttcattcctgaaggagaaaaacccacatggccagtggcaattccaagtgtgtcacgtagctggtttgttttttaatttactctatgaaatggttttctctaatggcatgccattgacgaaatgcaccataatgtctccatccatcacctccaaatgcttttgcatgcatcagttgttgactcgttttctcccattcagcacataaatgagaggaatgatttatccaaggccaccattactcttatgtggaatccaaaatagctctctggagaaatactgccctgagcacttatttctttgtgcatctctcaacttgtattgaagggtgactttggtctgggctataatggtatcctcctgaccagtgtttcctgggaagctaggccaggtctccatggtggtatataactcctggatgcaagaccttgtattcttctgggtatggctactagggttggatgatgagaaatgaaaaccagggctttggcctttggctatgagtgggcatttgaacaagcaatgagattccctcatgagctctctggaactcataacaggaagagaaagggtactacatatctgagtgcattttcttttccttttctaattcatctcacttccttgaactccatctccccatgctgaagacatatagccctttcttcctgtgagttttgcatagtagtagatcagaaatggaaaataaataggaacatcaaggtaattcttaccagctgaaaattccttgagagaagccgaagtatggcatctttaggatctactactgtctcaaataacagaaggggccactccacataccttttgtttcattagacgatggtgataatgaagataaaagatttgaagcatcaaatggcatagagatcctgggacattaaacacagtattcctctctgtagcattaataaattgtgatgaggtttgaaatactatatttgcctccttagttcttgtttcaaacagctgaaacatgtaacttggaaggtttcacctaagaaaatttgttgaaatcaattctgtaggaacaagaaaaataacaatactcatcacacattgtttctgcattaaagtattttcggtgaatgtatgtgtgtatctacctcaatgatgctatgtctaatatattaattctttcctgtgactggctatatttctgagtaccagcgaaattgaaataaggtgtacaaaggataacaacttcctacattgttttcttttcttttttttttttttgagacggagtctcgctctgtcgcccaggctggagtgcagtggcgcgatctcggctcacggcaagctccgcctcccgggttcacgccattctcctgcctcatcctcgcgagtagctgggactacagctgcccgccaccatgcccggctaattttttttgtatttttagtagaggcagggtttcaccatgttagccaggatggtctcgatctcctgaccttgtgatctgcctgcctcggcctcccgaagtgctgggaatacaggcatgagccactgcgcccggcctacattgttttctaatgggctgaataaccaaaattaaaaatccagagctaatcgtaagctgcagtggaagcaatatgttggtttcacatcttatgaatggaatctgtgttctgagattcagaaactgtggtaagttggcattgtacttctcacgtttttatttaataggtcattttcccaaagaagtgagatatccatgagtacagcatccaggaataacaataaaatgtgtttgagttcagagattatgcaaagaagtttacttaataaaaagctaagatgggggtgggagaatgggaataggaaggagaaaatggtcctgacccaaaactgaatgaacctttagatttcccaggtcaatatgtatgacttctgtacatcttttgatcactatctttctcaaaattataaattaatagatttgtctctctgatctcaggacaggtgagtagcctggttgttttattaatgtgaggtctgctagcttttatgggggaccaggagagctggacttctcatcacaatctgtctgtgatgggcttttccaacacaatggcacataagagacttttgtgaggatgttactctcaaagaagacttttctcaagaaataaatcacgtatctccagcgaagtgacaatatgcaggttattcttgctatacttgtggattcagcagtattcaatttattgatatgaatatttatatccaggccagtagcgctgcagttgttcgtagtatttgcagtgaatagcttggctgggatgctgaggacatcacccactgtttttaaagctcagcattctcaaagctatttaaagaaccccttcatcaccaccactttggaccaatgttaaaagcaattcagtagagacattctccttccataaccccccaaataattattgctgacctagaggcaattctgaaaggaggtatacgttagcccttctaaaaatcttatgtaggccgggggcggtggctcacgtctgtaatcccagcactttgggaggccgaggcaggcggatcacgaggtcaggagatcgagaccatcctggctaacacggtgaaaccctgtctctactaaaagaaaaaaaaaaaaatacaaaaaattagctggccatggtagcgggtgcctgtagtcccagctactcaggaggctgaggcaggagaatggtgtgaacctgagagatggagcttgcagtgagctgagattgtgccactgcactccagcctgggtgctgggtgacagagcgagactccgtctcaaacaaacaaaaaaatcttatgtagttccctttcatcagaaaattttgaaaaattacaattgaccttctttcagttgaatctatggatatagttcctttagtttgtaagaaaatgcttctgctacccagagaaaggtaaaaatattcggttttagccctattctagggatgaggctcagaagtgtgatggcacacccagtacatatcttttcatgtgcttttagtgtccagtgacttgcacttaaaggaagttagattgaggtcagcactggacatctgtatcttctcagccatgcaacaggtaaatgatatcataaggccctcctgtgctgggcactttacttagcataagattcagtccagagttaggccaaagagagaacccaaccaaagccttaactactagccttaaccacagcaccagggcaaataagcctgtttctttccaagtgatgggaatgaaaatcagtggtgctgttctgttttctccatctgctatcctataacacacagtcacaatcttctctactgatttttcgaaaaccaaactatttttataacactttttgggggacatgatatgtataaacaggaaaaaggtatcagtaaattcatttataattgtttagccaggcacagtagttcacacctgtaatcccagcactgtgggaagctgaggcaggaagatcacttgagctcaggaattctagaccagcctgggcaacctggcaagaccttgtctctactaaaaatcaaaaaaattagctgagggtcgtggcatgcacctgtagtcccagctactcaggaggctgaggcaagaagattgaagattgcttgagcctggtaggttgaggctgcagtgagccatgattgtgccactgcactcctggctgggtgacagagcaagatgctatatctaaaaaaaaaaaaaaatgtttgatgatatgtattggaaaaagaaatgaatggtaagtaattgatcttgaatgatgtagtttggagtacatgtctataagccagagaagtctggctaatgttaaattttgggaattaaagtttcagtccttttaaacttttcactctttggatgatgtctcatgacaggttaatgagtgcatgctctagtcttcaaagatttaggacatgtctggctaatattaacactgacatctgcaaagtaatattggaatggacatccaaataataaagaatggctagggccttgatcatcctgaagctttggacacatcctagactttcctacagttttagggtattttccttttcattccattaaggcacttaaaatactctccatagagccaggtgcagtggtccacatttgtaatcccaaagctttgggaggcaggagtgggaggattgcttgaggccaggagttcaagaccagcctgggcaacatagcaaaacccccatctctaaaaagaaatatttttttattagctggatgtggtgacaggaacctgtagtcctagctactcaggaggctgattaggaggctgatgcaggagcttgaggttacagtgaattgattgtgccactctactctagcctggatgacagagcaagatcctatctctaagaaattaaaaagtaatatgctgtataaccctgatctctcgactgccataaaatctttcttgcacctaaaaaaatgttaaaaataaataaatagactctccacaaatacttatctctaattacagtgaaagatgttactacaagcttaatactttaaatgttttaaatacagtgttgaggtttcagtctgtctttgctgtcagactggtatttttttaaaaagtatatatggatacaaacatgttaaaaagtttaaatatgtacatatccttgtaatatatatattttctcccaatatgttttatctattctgtttaaacaaaatcttaaaggttagagtttatgaccttaatttggtatctgcagtttataaactttagctggtaattcaacctatttctatgaatttatttactgagactctacatgaatgaggtctttgctacaaaggaaacctttctaatcttcacccattgtccatttacacatgagtaaatatgttaatctgttcataaaaggataaaataattctgaagataaatgcaaaatgacttttacaaagacacaaaacagtacattacgttctactctgtgtgatgcctgccaacattccagaggacagagtattgataaaataccaatttaaaggattagaagaaatgatttctcgaatcaagaattccatttctctgtgatggaagtcttaattctagaggaaaggagaaacatatatttttttcttacctttgtaatttggcaattcttaggctaataaattagagtaagtggtttgtctgagacatggagaaaattggatgcagcatgaaaaattaacaacagtgttaatgagaaaatggttgactcataagtcctgtgcttgaatttagtatgcaaggtgattaggtcttcacaatgttgtttattaaaaaaaaaagtattggatctttttttaatgtttccatatcctgccaaggtcaaagaggacaatatctgttttgtcacattatgttttcatgtaatggtggttggtttaatgaaattgttgtagaagagctggccgccagggtatatcagacttgtgtgtgtcacttttggagcatctttcacaaacaattagctccttataagatgtatgatcgtcctcacattcatcacgtatgtcccatgcctctcaaataaaaaaacatttataaccattatcatcaaccaaaattaacctgggcccaactgaagagaaggaagtcaagttttcagtttttggttggcaagttaactctttcaagtctgatacataccatttcatgctccttactggatggactttggcatatttgtacttccagagagtttttttctgatattaaggaaagtttaaaagctttctcttggctgggtgatgtttgattgcaaggaactaaaacttactccaatttgatcaataaaagagaggtttgttacaggatacagacataataaatttcaagaaacaagaagcccagagagggaaagaaccaagaatcttcaggcaacttagtagcctcatgtaatctcagtagttgttcatggaccttctatctgattcttagtaaaaaatcatctgaccatctgatcagcttagtaaaaaaatcatctgatcagctttcttctagtgaatgaatggtacccccaggtcatgtgttcaccccgatctaataaacggtaaccccagtaaggtgagatctaaagctacccctttatgggaatgagtggggtaggtagagtttgggtcagagtagtgtgttaatgaggacaagttttgagggtgaatctcataaacattattcattattcattattcttatccacagtcccaaacaatttcagccctatcacttagtaactcattagcatgactgtggagattggctgaaagaatatgagtgaattgaggcaaatttaactctgctatggaagaagaaaaagctgtgataattcatagcccttgaggtactgataggaatcattagtaccatgtttatctgcaaggataatgacttaataccaaatctccatcccagtttcttttgtttcctacaaattggagaaatgaattggtcaaagtcaaggaaggaattggtcaagctaagagatcttgcaagatgtttggtctacattaaagacccataatagactgatttttaattacaaggttgtcagttcacagggtacatggttgaaaaaatgaacctcagatgatgataatggtggtaaacagctttcatttttagtatcatatttttaacatgggatttgttaaaacagcaggacaagactctactccccactagctagtgaggtgtttattgatcaaattacttaatctcttggagcctgtttcttcatcattaaaatgggagtgataagtgtactgatcttacaggattgttgaaagaagtcagtgagaaaacaaatgtaaattgcctagcatggtacctgacacatgtgagctactactatcaagcatttatatagaccttttatgaatgtcagtggttgttttatgacttatcttccttgaatctcagaacaatccgatgaacttagagcagtcagtgaaacagttaagtcaatgttatagtttgtatcgccaaaattagataattgagtcctaatgattacgaagtcaacgaatatcaaccaaatttaacagcaaaataaatacattattgaatatgtaagaactatagtatgcttaccacctgtgtactccatatgaaatttactagaggagttgctccagaaaacttataacaagatccaaagtgaaaaacaaactagcatacaagaaatagtggctgataagtatgactcagaaaatggaaaagaaggtagaaaaggaagaggatccatttgagaaacttagaaatttctcttttaagggtttaacttctatacttctcttaattacattagtttatttcacagtaaataatattttctgaatcacaacccacaatattgttggtttttaatgttacaatttacatacaaagcactaaaactgaattacacttacagaacagaatataagccttgaaaatgtgacaataacaatatacctaacaaaaattaggggtgacatataggaataaagaagagagatagaagattgagcatattagtggtcttgtctttctttgcagggaatcactagttactacctaatttgatatatccagaaattgaggcataaacataccatgtaaattttaattgctgctaaagtagttgccccaggattgggacaagaaatggaagaattttactttccctttctatttttctacactttatgaattctagtttgcatgtgtatgcattactattttaatttttaaaaataaactgaaaaaagagcattcaaactcatggttcaaatggagataattctattcaggcacctaaattgaaattatgggaaaaaaagagtggaagctgatcagatgtaggaaggtgtgactatgagcttgcaagtaaacctgggttttccttaattaaatttggtttccttctctttctccttgtttcattgagctgaaatatggaattagaaggcacatattccagaccagttctgcaacacaaactaccaacaactttcaagacttaaatgtacagcaaccataaaatgtatagttatgtctaagcataagaaataagcagtctagagggtaagaaatttaagaaaaactgcaggtatatacaggcagctgctaaaggctggagtgggaatatatttagcagtggatatttgctgccattgaatgcttaaatcagtgcaggtggggcattcaaaaggcttctgaggggtcaagttgctccagatattttgcaaggttatattgtccatgaatgaatgattttgctttatgtccctgcacaggggagtcagaggacagtgttcctttcttagtccccaaggattctcatctgttgtgaatagcaaaagcccaaggtaggaggatggatcagagatctgaaatccagagccttgctggaatgcgttgtccttaaaagcaagcatctcagtatgataaatacgatctcctcaagcccgttagggaatggaaatttaagaaccggttaggtcaaagatcaggaaatttatgacgattatctgcggttacagtgtagagtgtttgaggatggtttaagccaaagagtccagtgcctgtaaatcttgagagtgatattaatacctccgtgaacatgtgtgtacaacgtttctgaaaagattgattgcaaaggccagttcccaggaaagacaagcaggtaattggcatttaattaatgagaataagttatattaaattaaagacttataatccttgattatttatcttcctgtagccagtgtgacaatctactcttagattattaactcaccactgtatttttaagaggccaaactaagccgtctgttcagactgtataaataggaatatgtttgcatctcaaccatgggaacaatatcctttgggaactcatgagaggcttctttctaatataaatgatttttgaaaaattgaatccatgcagagcatccaaggtattcttaggtctactccatatccccagaatccagaagagttgacatgaaccattgtgtagtaggaaggttatgaacttgagggtcagcctgacctgacctaggattgagtcctaactctggcttatattaactaagtaggcttgggtatgttattaaaattatctggggttcagttatcttatcttcaaaaatgggaaaatagtactgacctggaatatactattttaaaaactaaatgatactgtaaatccccatggtccattagctatcacatagtactcaataaaagcccatttttctcttcacattctccttctccttttgtagcacaggatgatagtggttagaaaatgattcagaaacaaagttggaggcttcatgctacttgaacaattatgataaatacacattaatcaagatactatggtactggtgaagggataaacacatactgcagtggagtagaatagaaattccagaaataaagccacacaagtatgacgaattggtttttgaaaaaggtgcaaagacaattcaaagaagaaagtccagtcttttaaagaaatggtgttgaacaatttaacttcacatgcagaaaaaagtaagttgtctcaaaagggattatctaaatgtaaagcataaatctagaaaacaggagaaaatattcataacttggaatgaggtagagttcttacatatgacaccaataatacaatacctgatagaaaaaaatttgtaagttgaacttcattgaaatttaaaacttgctctgtgaagtatgctatttaaaaaataaaaatacaaattacagagtgggagaaaatattttcacatcacatatcaaacaaagatcttgtagctagaatatataaagaagtcttaaaattcaaccaaattaaaaatgggtaaaaagttgaataaacacataaccaaagaggatctgtggatggcaaataagcataagaaaagatttccgaccttattagctactaagaaaatgcaaattaaaaccacaatgagataacattacatccctattaaaatggccatttaaaaaaaagcctgataatatcaagtgctgacaaggatgcagagcaactggaatccccatgcattacttatagaaatgaaaaatggtagagcctcctggaacacagcttagcagtttctcatgaatttaaagatacatttacagatgatctagcaatctcacttctgaatatttaccctagagagatgatgactcatgttcactcaaaaacctgcatacaaatgcttatagtatctctacttataatcaccaaaaactgaaacaatccaaatatccttcagcaggtaaagggataaacaaacagttgcacatccataaagtggaatactacttggtaataaaaaggaacaaactattggtacacacaacagcctggatgaatcgcaaagacattatgctgagtgaaagaagacagtctcaaaagatatattccacttgtatgatattctgaagaaaacaaaactatactgatcagtggttgccaggggttaggatgggggcaaagcatgactacaaaagagcagcacaggggagtttttggggctgacaaaattgttttgtatcccgattgtggtagtggctacacaaatctatactgtgttaaaactcagaactgcacaccaaaaacaagtcagattaactgtacattaactttaaaaacaggataaaattaaacatattttgaaaaatgatcccagcaagaagccattctaacttatgataaacaaggcataacaccccagaactctgggagtccttaaatataatttgtttattatttattgggcaaatgtttattgagcactacctatgtgttcacattgttttaggcacagaggatgaagttctaaacataacaaaaactcctgggaggttatattataataaatagtaactatatactatgtcagatggtatacatactcaggtaagcaggataggaaattgcaggaggttgtgccaaaccatccctggacagagctgatttggtttgagataaagggaagggaattttctatggaaaatctcttacccaaggccaagatggaactctggtctgaaaatcctttgagttggaggcatgctttaggcctggatgataaagccaaagtcatctaaagaccacagagactgtccaggatgtagtgagagcagagatagggttgtctattagagactgtatccaggatgtagtgagagcagagatagggttgtctattaggaaggacacagagggtgggacactggctgtgggcttccagtgatgtcctgagtacccagcaggtgtggtggagaggcaagactctgacccacatgactcatagttaatttgagaaagagaaacaactgtcgatgagaggtgatctccagattgggcacaaattgaaggttcccaaatacaaggagtgaatgttcagggaagtagtggctgggaagaaccctaggatggaaagaggccagcaagaggaacagagggaagacttgaaccaagctgacaaaatgccaggacccaagcatagaaggcaagataccggataaagtgtttggaaagaagctagtggacacactttgccttaaaccctgagcacattttaaaataggcacttcttcctcagatattgctgcttccttcctcctggttcagtgactgctccttgagtctatcttggaggtgagcaaaccttaagtggggagcatgaacactctctcccatctgtctatccattactatctcatgctcctgagctccagctcagggaaatccaagggaacccgtcccctttaagaaccagtggcttgcagggactggctttctgccagggtagaaaagtagagcaggagacatttaaagccctgtttgaaaactgtcatttttccaacgacctcagatggggtgattaatcaagaagcaattccggagagaagccatcttctttacctgcttaaatctcccaggttaagttgtattttaagccctggcttattttcagacaagtttgttgctgttgcctaaccctatgttaaagtaattattgtctgcgaaggtcacacagagttcagtggaactgaaaaactcacagcctttagtattaatggggtaagcagcctgttcagggccttttccttaaagagacagaccggtgagaacagtcaataaggacaaaaaagcatttgacatttcaagagagagaaggcttattctttttgtggcttctggcaaagaccccaaaatcaaacaaagaaaccattagaggggagtcaatcgctatcttctacatgccagtgttcaaaaatgttgttgaatttgttatttgaactcaagtgggaagttagaaattcaaagtggaaggaagagaaatagtatagtttgaacacctaccatacaccaggtgctttacataattaccttaattctcacaactacttctttgaagtagttatatgtactactattatatgtaccattgcagatgaggaaactgaggcttagagaggtaatttgctctggattacacacttagtaactggcagagccaggattagcatccaggttggtgtgactagaaaatgcagacccttttcatgtgacttcctgaatcacattaatttaaagcctaatgttggggctttagatgtgaaggtaactggggaggttgaatttttccatttttaaattgatatttgattctataaatatatattatgaaattcatttcaaacaacacttttcagtttggcttctatgttgattggaaaataatgagaactaatagttaagacttaataaatgccagacattgaagcaaaatgacatgatcttattgaatccacacatgtacacatatgattaaacatttagaaacatacacaatcattccattttacagagaaggaaattgaggcttagagaattcttgttcatatatcacaggcaatatgtggtagagccaggatgcgaacccaagcaattttatgtgagagcccactatcccaccaactgtttcattcagagaccatggcttctactgcctgccccaccaactgataacgttaggtacctggcccagatttcctcaatgaggaacctgagggctggtctacaatcacgtccaaagtacagagtgtatgagcagtgcaagacaaagactgaaatgaccacaccaaagagcaattagcctttgtcttttaggccattcagcaaaaaagctgctgagcttccctccagagggaagccactttataaagggagttggggcccaaagccactgggcctgcagttcagaatcaattccctagcttctttgaagcccctagacagttccatctcttcacttctgggatctgcaatctatctgtggcctggttgtggtacgttgtttaatggctgcaaattttttccattccaggatccaggcccctgtgcactataattttgccactctcctgtcagggactagagtctatttctccacacctttgaatctgggctggtggtgtgacttgctttgatcagttcacttccatcgtctttgaatgctgccctgagaccaccatacaaagaaactggtctcattgactagaagataagaggccccatggaaggaagggaggtgccttagccaacaggtagcaccactgccaaacatgtgagaggggcagccatctcaacctttgggcccagctaaccttatagctgaatgcagctgccaggcaaaactggcacagcaaccttggagccaaaccaaaggatcctaaaagatataacaataagttgttgttttaagccactaggttttggggtactttgttacacagcaaaggctaaccgaaacagtctttctttgaagttcagagcagcataagggtgcactcttggttgacatatttcagcgcctgccacagggcaatcaatggcagtgatatattctccagactccggcctccattaccataaactcctccagggaccaaaggatggtttcagggcttttttatactttggccaacataagtggatacccagactattaggctgtcaacatttgaggcctagaaaaagtactgtaacttttccttaaagagacagaccagtgagaacagtcaataaggacaaaaacacatttgacatttcaagagagtggaggcttactatttttgtggcttctggcaaagaccccaaaatcagacaaagaaactgttagaggggagtcaatcactatcttctacatgccagtgctcaaaaagtgttgttgaatttgttatttgaactcaagtgggaagttagaagttcatatttctggcatattttaaaagaagctgagaatcaaaattagtaaatatctagttgaatatctgtgaaatgtaagaaatgctagttagatgcctgcatttcgacacttacatactaaatatatttaatgtggactgttattcttgaatagatgatataagaggcttttttcctaaaaggcaggtgatctggggcccatgaagatattgagtagctgtgggtattttgtgtgttgatggacttgggaactctgtgtatttgaccattaacttgtactctgatgccccaaattattgctgtgttatgttatctggtctttagggagaacattagctgtgaggttccaaaaactaagggctccctatctacctgagtcagtttctgaaaaggctaacacctgcctcagcctctcagagactccttgatccagagtcaaggcaaccaaattgggcagagtgacaatagaaaagtaacaacatattttctagagaagcagaagattgtggtggcacagtgtatgataggatatgtaaatgaagccattcaggattattaaatttgtcattggttaactgagaattattttaaacctaaatcctacctgaggaaaggaagcagggagtccctgaatttctgcccttcagaatcataaccaccagcatacattttatgaatacatagaagcaaaagctggcatagcagcttagcaggaggaccacaaagaattcctatttcatattaaccctcagtgaatagacaatccccagggcatcattttcaaatataagggttggccacttttgcctgagtggagttcttagtttggttctgcgggtgaccacacacactatgttccacctcatatcctatctcttgtagttgggaatgtacccaacctcagtcaaggctcccgaattcagtctaagctgtcaaaaggctctgctggaggaagaggtcagcttcatcgctagaggccactaaactcattaatcacttttgcaaggcaactgcttggtggaggggccttgttaaaagccaagattgctctgaacttaatctaacacagttggtcctctagagaggtgctgaggggttgtttatgagaatgggaaggtaatcaagacaccatcagagagaaaactgaataatttaggtcatgttcatctctctctctctctccctctctctttctctctctcccctttagtaaaccctgtgagcatctccaaggcactgaggacaaaaatatgttctctgccttcaaaaacttcctagtctagaggaaactggcatagacacaattaattgatgatctgatgaattagcattgtgtgagctacaatcctggcatgaatcaagaactagagaggcacacaggaaggaaggaagatgcctctccttggtgaagacaaagaaggcatgaggaggaggcgacagggaagctcacctggtggacaacaggaaagactgcggaggagggctctgctggaagaggaaacagactggggaggtggggccagtgcataaagggccactgcaggaaggggttgtaggagaaaaggaaagacagatcagtcactgatgaccccctccaccccaggtctgcagacagagctgattccttctctaagcctcggcatcccctaccaacagtccctcctgctccttctctcccaagtcctctaaacagcttcatgcccaaaccacaaagagaacattctcaggcctaaggcaggccttcccagcacagaatgtttggagccctctgtgggagagcggctggcccccttaactgtcccccttccctccgggagccaaggcaggcactgtgcacctgcccctgaattgtgtgcggcagttgccggcctggagctgagtgacacagcaggtgcctccagcctgaagacaattccatatttcaatggagcgtcgccaccaaagcttattatctagggcaataaagtttaggattagggggattcaggatgattgtgtgattctccacaaagcttatcttctaatagaccagctgctttattaggccgcccccacccgcaccaggcccttcccaaagcatcccaagtcccaggcagccgacgggggccttgaaggcggcagtggtagacagctgggggtatcatatcaccctcagtctccatctgcgattattaaattacgggcggcttccagctgggcacaccccagctcccaccttcctcctacaaagccagcatcatcgtcaggcatctgccaaggacacgatgtggctgcctctcccctgctgatccctactgttgaactctaaaagggccaggtctgggtatttacttgctattagggctgtcactgtcacagtgtggaatgcagtggagtggaggcctggagagagggggggaccatggaaatttctgttgcaaatggggctttgctgggactgttcactataaacaaaaaaagaagatggaatcatgcaccacagaacctcaaagaagctggcatgcttaccaagctcccacatatttctcccaaaatgaaattcattaacgttgagtgttctagggaccacctccacatgctccctgatcccattgctccgttccttttctgatgggagcagagcatgggatggtgtctctccaaccccgtgtggtcagcagcactgaggctactctcgtttcctatccctccctgacagtctcctttatcctcagcccctgacagactatctgttcagagtaggaatttatcaataagtactgataagcatgctgaaaggaatatgggggactgggaatatgcctgaaacataatgaatgtttcaaagaaatgaaacgttctgaaaatggaattttcaaagattctgacaagcacacagcatctgcttgcagattttaggaaaacttagtcatagaattattcagagttcacatttcagccatggggatgttgtgtgcctgttgacagcagaggtccctgtagacgtttgttttttactgtgtctatgtgtgattcactaatgagagagtggcttagatgctcagagtaattaattgtagtattgagataatagtggctttgaaatccagctgtgcttatatgcgtgcacgctgtgcagttagatgctcccaggttcagatctgcttccatcactactaactatgtggccttgttttctgatctgcaagccatggattgtattgcttactttgcgggactgtggtaaacgttaggcatatatgaggcaagtgcaatgcccaacatttggcagatgcttaataagtgttggctattattattactactactactactattgcttttgctattgctattatgtgtgacctgtataataatcctactaatatgagtgaaggcaagaatcatggactatgcacccagcataatcaggagggtttgactgttgtgaatgaattcaagggcaggacaagcagcgacaagagttactgaagttcatctgatttgagttctgttcattcatttatttgggatccaaattctgaaccccagctctgtgctagacactgttctaggtgctgggaaaacagtcatgtgttagtctgtttttgctgccataaaggaatccctgagactgggtattttataaagaaaagaggtttatttaaatcacagttctgcaagcctaacacctggtggaagctgccaaggcttacagcttataccctctcaagcagcaccctaatctataccttgagccaagactggaattggagctgccatgatgcaggaagcagtgtcccaaggatgtgcagagcagtggggtcctgaatgtggccccccaaaccattcttttctcctaggcctctaggcctgtgatgggggggtggccttgaaaatctctgaaatgccttcaaggcctttttcccattgtcttggttattagcacttggctcccctttagccatgctaatctgtctagcaagtggttgctccacagcctgctcatatttcactcctgaaaatgttctttccttctccaccacacaaccagtttgtgaattttccaaacttttatgctctgcttcccttttaattatcaatttcccagcctcagatattcctttatagtaatgcaaatggactaacagaagcaatgaataagaaggggtcctggcccctctacaactcatcttctattgagaaagaaagaagaaaaaatgaaaataagttaaaaaaactcaaattttgataaaccctatgaagaaaataagaaatgggatagaagttagctggcatggcagggtggagtgggtgagtgacattaaggagggtgacaacagagaaactttctgataaaaaacccagtaagtaaaggtctaagtgatgtggatgaggcagccacttgaagacctgggacaaaagtgttcaggcagagaatatagcaggtacagagctttttgtataagaaggtagcaaaaaggccagtatagccagagaacagaggaggtaaggagaaagataggggatgaggcaggtgctaactcatcaacatccttgcaggccttgatgagagttaagatttcattataattgcaataagaagacagtggaaggttttttggcgggggtgggggtggtcaatgacatgattggattgatatgttggaaaagcccatctggcgactgtgttcagtaacagtgtgcttgcatgaagatccctcacagcagcagacaacacaaatgccccctcccacccatcatgaaaatttggaaagccaagccaataggaaactgaagctacaaagacccagcccctagaaagcaatataaacaagaccagaaaaagcatgtgttcaggacaagttcacattgaagtaaaaccatattgacattgattgcattccctacctgcttaggggttttgcttcacctaaactagtaccttgagaatctgtaaaagcttacaatttgagaaaagcaagagatgacacctgattatcctttgaattggcttccatgtctgtggctgttttccctaagttcctgtcccttacacacacgttacaaaactttgtctcaattctttgcttttaaaggatttgactttaacaaattcacattgggtacttgcttagtaggaaaggaaataatgactctcaccccctatgttataaaacttttaggagtattacacacaggcacatacagggcacactggtatggcttgtcattttgtgacaaattcttgtcagtttgtggtctggtggaaagcatatggaattagcaatcaagaaaggtgagatttagttctggctctgcttctaactagcaatgcaatcttggacaagagatttattctttcaagtctcagtttcatcttgtcatatggacatagagtgatacttccttttaaaagaacctgggtatcctggccaggcgcggtggctcatgcctcccagcactttgggaggccgaggcgggtggatcacaaggtcaggagatcgagaccatcctggccaacatggtgaaaccccgtctctactaaaaatacaaaaattagttgggcgtggtagtcccagctactcgggagactgaggcaggagaatttcttgaaccctggaggcggaggtagcagtgagccccgaggtcgtgccactgaactccagcctggcaacagagcgagactctgtct

SEQ ID NO: 34 - DNA, 87925 bp, Homo sapiens
tttcaggttttaaaaatcaatttgattggccacaggaaacgtattttggcatctctgggagacaggctgcacgacgatcccccacagaagccccctcggtccatcaccctcagggtaagtgccaagcacattcatctggttctctgcccttatcttaagaactatttgtttgagaccagcctggccaacatggtgagaccctgcctctactgaaaacagaaaaaatttagccaggtgtggttgtgcctgtctgtagtcccagctactccggaggctgagacatgaaaatcacttgaacccagaaggcggagcattgcagtgagcagagatcgcaccactgcactccagcctgggcaacagagtaagaaaataaaagaattattttatgtagttttataggttttataaacgtgcactttatacaactgaagcaatagatcaggaagtgctggctcttttctatgaagtttaccatatctgtgtagaaaacaatctgtcttttgattgtttgacacaatcaaaacaacaagatttgtttttctagattggttaaatatatatttttgagatttagatatccatctataatggaattcagcctgacaaaccactacctttaaagaaccactccctcacctcccatcccacaccccatctacgccaagagagcggaaatgggttttctgtcagactcctcaaacccacagaaagaaaattgatcaaggaccacagttaagtaaagatcaatttaaaattaaccttagggtcttctgtttttcaagaagtaaaatttgtccagctttactcacttcaaaaattcagaatagagaatctaaaaccttacttaataaattgtatttcttttattcaactacactttagaattatgaggtaggggccgggcgcagtggctcatgcctgtgatcccagcactttggaaggcagaggtgggcgggtcatgaggtcaggagatctagaccatcctggctaacacagtgaaaccccgactctactaaaaatacaaaaaattagccgggcatggtggtgggcgcctgtaatcccagctactcgggaggctgaggcaggagaatcgcttgaacccgggaggcagaggatgcagtgggccgagatcgcaccactgcactccagcctgggcaacagagtgaaactccatctcaaaaaaaaaaaaaaaaaaaaaaaaattatgaggtaggaaactaaagagaacctgtataaaggagagagaaataaagaggaagtgaaggaagggagggaggaaagggcagagaggaagtgagaaagatgatttccaggcaaaaatggcagtggcaagaagtggccggcagtcactggtgttcatgagtcctacaagaacttttctaaaattcgtcgaaaagctgagatctccctgaaagctgtggggtgcccactctgctctctattttgtcctgcacttgcttgcttctgatttcttttctgaagagatgaacacaagcacggcacccggacgtaaccatcgtgatgaaatgcagtgggctgcctcttatcaataaacttcagcaaacagcatagccactgtcaggataacagagggcaggacaggaaaggagctgttaggatttggagttgattcagctttggagaggaaaatgcgcaaggatttcaggggatgcaagagaattggctccaggaggacaagcttagcctcctgagagagactggagtgggatgggtagggactacatgaatactggtttaattaattactgggggcattagggtacactgggatatttggaggctacttgagagttttgggagtcataaaagtacaaatagaaatttcaccccttagaaagaggagcctcaaataaattagaaaaaaaaaagatttttgttttgccttcattttgctacatggaaggagagaaagatataagcaccatcagtgtagtcaccctaaaatgactctttagaggagtcatttcctgctacttaccctgctctttttccttccccttctgaacctctcattctggctctctggaagagatttaggggaacaaaaaaagatcaaagacagagatttccatgcaaaagtataggacctaaatctatcatagaaggtccagaatatccggaggagaagggatctggagaaacaccatgatcccaatcctcattctacttgcaaatagtagagctgagctgtctatgccccctatcttcctcctgacccgtttcccttggatggagttgtctttgccttggaaaagcatcctctgtcgtagcatgcactgctctgcagtctgtgcgtgtgacatgctgtgttgccgtactgtgtcctcttcccaaccctgttgtcagaccattctttgatgaaggatcaagacccattgggtctcattttagctttctcatcatggcatctaccatggtgaggacgctctgcccacatgagggcccagttcctcccctgtaaacacatgcagtagtgtcagaggtgcccaacataggtgtgcctccctcctgagaccatccatgatgctgctttaggaaaacagaacctgactcttgatatttcagacctttgacctgaaatacttaggggaaaaacgtattgactagatcatgccattaataaagtggtggaatgtcattcattccttggctgttgcttcaaaagcgactccccacccccacagtttgtcttgtcagtatttcacaattttgaaaccaaaggttagccacagaacatggtatttatttcatgatgtatttccattcaggaacccagtggtaatcacactcctcctcagttgtctccatcacttagccaaagcacttacaccactggtggctccctagacgttcctcacattatcatgcagggcgatgcaaggaggagaagaaatgaaaactactttgatgatattccccgatcaaaactggagaggcagatggctcaggtaaggtgttataagcctttgtgatatttttcaaccatatcaggtaatgccttttaatagtgaacagtagcttcctatggatgcttattgtccgtgcctaactagaatttataccatgttatgccccgcctttcattccttgctcatctgaactagaccgagacagaaatgtctgggaatggaatgtgtacacatgtccttgttatgcattcctgctgaagaaattatgtctgatctcattgcacccagaaagtctttgccctgaagggaataatatagtgtcaaagtcaaatcataatgaaaatgagtaataaaagtctagattacaaaatgtaaattggttggataatggggcagaagtttggggggaaggattaaccctgtgtgatgtggttaatttcctcccaagtctatacattcatacagaaatgctctactgggactagttgcgttttctcatattgtcaccttgactagttgaaaatgatgatgctttctagcacaagtaattgaaaagggagatctgtcacgttcagacctttccatgtttttagtagggatgttcatgtctagcctgtcctcggattgctgcttagaaacttgagtcagccttaaccgaacagtggcgctgttcttaatgtacattcagatgggcgggtagctccgcatttcaccctgagattcaaaaatatggatttgttgtcaaccattggcagaatcaactcttttcatcctcattctaggttcagactgatgtgcaggagtcttctctctgcctcccacacctaagatgggaatctcgaggtgaaaatttgactgtaattgctttgccttggttgttaaatatttttctcaactgtttagtgagattttatttttaaagcctctggtaaacattgtatgctgcagctcacgagagacaaatgtgatgagaatgttctggaaaccatggctattctgcctgcagatgccttggggagagaaggcctgggatactgtgtcttctttcagctcctttaattttgaattgttctctgggttctttgtgcaggcaatggcaatgttgggattatggagactcttttattgaaaggggatggaaaatataggagaaataagaataattttatctttctctgttgctaggtattgtcttttaatttttattactgttttcactggtgctcttttaaatagggcatctgaaagctttttccccccaaacttttcatttatttcgttacttgttatattttcgagtcacatatgtggttaaatttctctaatgacagcatttcagagatgtggtttgttttaactttgagccatgttgtctttgtgtattaatatgaactgggtcttttctgagcccatttcttccctgggtaagggagtatagttctttaatgagcattagctattattgactgtgtcaaccgcagtatagcagaattacctctctcagctgctcacataatttatgaaatttctccatatactgcagggtttttttaaaaaacgacttacccttctacctatgtataaacactcagaggtggcctagcaagactgcacccttacatgctgcctgaggttttcgaaagcaggggcagtagtaccaaatagcacaaatcttttaacgggtcactccaatcagaaatgcatcccttatgagaattgtcttgccttgagaaaatggaatgggcttttatctggccaggtgaaaaaagcctaaaagcagaaaacagagtgagataagcaggctgatgggacgtagtgaactagagcacctgtgcacgcatgcattcccctcatgtggagtactaacgatgatcgagtgactgctagacacacaggctccatcagccatcaggagcttattagaagctttctaaaagcctgctgttcaatacagcacttctgctgcagagaaaataggagatgacaccacaggaatctgatcaatgagaaaaagggattctggaactgcaactctctgggtggtgttaattgcagttttgagcatgatcgctagtatggaaggccaaaacccatggagcaatgaatgcatacctcttaaaaatactgctttaacctgtcaaaatatgaaatactctgtcatcttgttgttgaataattcaatttatgtgacttttcaccactcaactactcaattgatgtttgtttttttcttattctaccttatttttggtcatttgctgtaatactttttgaaatttatatacttttttaaaaacctgtcatatctctctagaccatactttttcccctgaagttatgtgtttagacaatcgagttgggtcttcctaaagacttgaattagcaattaaaatttttgcaagcaagcagccagttatacctccttccaacctggagctccattcctccagttctttcccaaggagtttctcccaagaagcttactgtagcttggttaatgcttgcctaaccagtccatttcccactaaaatgcaaaagtccaccttcaggctttctttcttacctactaaaagaaatgagaatgcagttgagagaaaatcacctggacagatttatgttcttagaaacccctctacttcaagtttagctgagctaccattagagtgatttggaattctagccctgggccagaaaccttaagttcttggtggccgcaataattcattaggagttttgccttcttgaggtctgcttaccagatgtttggaggtgctttgcttaacttggaaaagcaatgcttaaagttaaattgagataaatttaatgtccattttacctgttaaatttgttggcagatatttaaaataaaacactagaatggggtttaattgattttttcaatttgaaacaatatttaaaatacctgtcttgggatacaggggatttgcaaatattgtgagtattgtttgctattattctgatataagcagtactctggcatcaaattattttaaatgaatatgcaagaaacaaaatttgagttcagcatgaactgaatgtaatgatataaatacatctgaatgatgggtttcctatcatgttgaaaacatagcttctccagcctgtaattctaaactggactcattagcccagaagttctgaaacactccccaatttccacacccctaataaataaatgttgcattcacatatgtgtaattataccttaatgtgcatagtgattttaaattctcaaagtactttgacatctgttatctcattttagcacaaacaaggtgtcctacacactattaatgtgtgtacagcacatggcagatcagcttttaattctgagttatgtggaaatgagatagtaaatggaaaatatatcagaaggaggaaaatattttcagtatttaggacctaattgcagtcttcagaagttttcttgaatgatatttagaagtcgaagtacccttaaaatgaacaataagagagtgatggaatgaataaggttaaggccacattctccaaactcatgcaagaaaaaaaaaagtttccaaatgctgcaagttaagccatttatagaaggcttccatttacagaaaaacgtatgagaaaatgaaatagtacttgtattttcacaaaacaaaggcttctcaacagtaaaagaaatgcatatctttgcataaactttagcttaaatattagtgagaatagtgtgtaatataaaatctttatgttttgaatgctcttgcctaagatttaaaaaaaagcagtattacctgggggcactaaagacactttttctaaattattagaaaattaattcagttgcaagcttaatatttctcaatctaaatagtattaataagtacaactaggtcaattacttctctatttgaaagcattttgtatattacattttagttcttccaaggtttgttgttttgatattattaaaggaagggaagtagaagctgagccatacagaagcactgctgtgaccaggttcatgcctgggattgcacatgcagtatcttatttaatcctcacaagagcctatgtgcacatctgccaaacagggtgagtgcttggcctcacagctggtaaatggtagagctgggactcaagccctggcctgcctaaccctatccttgttcttctatagtccctgatgccctgtgcctgcctctgtattaaaatgatataaaatattttaaaaacagttcaacaaatactaatttctcatgtgccataatagattccatttatgtgggcacagcaagcagaagagaaaatcacagtagtttagtggaaactgattgaatcaactcgtggttaacaccatgaaatccttaaatgcaaaactgcactggttatttgttgatccttcagcagagaccctgcacagtgtgtcagaacgctgcctgtctcccatgtttgtgaaaagctttgtaggtaggtgtggggttaactctgtctacaaacaaattcttgcttgtggtgtttctccaaatagtcgatgctgttttcttagtggcttcttcggttggaattctgatttggtttctttctggctgtgtgacctggaccgagttatgtggtgactctgaatttcaatttttttgtctttaaaatgtggataatgtctgcttctcaggcctgtatgtatcagataatttatatgaaagcatattctaaactgtaaagcactatatagacagatatgactatcggttcagacccatcacctgtcagtccctaattcaaaggtccctgctcattgtaggccaattaatgacaaagagagttgaagggcaagtgctccggtggttgtagcattctataaagaccatcttttgttccagtgttacccatatttagcatgtagattgagaatggaatttgcatttttcttttattattttaattgtgtaaacacatcatctgccaaggagcatatatcacgatgcagagggatctgggtagaatgatgtcaaagccagggaaagcagagaatggatgccatatttctctaccaattcaggttacaaaattgtaacaaaaaatatcatatggtaataacacgttattattgtaacattgttagataaaatatcaagtgagagggcttttttttctttaagtgaaatttggaactttatggaaatatattgtgcacagaactgttagcttaaaaagcatggatatcccagaaagccatgaggcaaacactttgccatgtctgggaaagaagtaggacagtaacttctcctcttatatacttttcctgagagaataggcctgttgttcccagaaattctacccactgctctggcattactggaatttacagaatcagttttcagaaaatagcacaaccaagaaaggaacagcattttggaaagtggcttttttggccaggcaccgtggctcacgcctgtaatcccagcactttgggaggccaaagcgggcggagcacttgaggccaggagtttgagaccagcctggccaacatggcgaaaccccgtctctactaaagactcaaaagttagctgggcatgatggcggatgcctgtagtcccagctgagacaggagagctgagacaggagaattgcttgaaccctggaggcagaggttgcagtgagctgagatggtgccactgcactccagcctgagtgacagagggagactctgtctcaaagaaaagagagtgtttttttccccaaactaaacaagttttcctattactgtgtcacatcagattttttgtttaatgtccgtaagttaatgcctagatttaatttagattttcatcacatagccactactcagaaaggctcagcttgtccatgatttcaacatttccttccatgaaggtctaaagagcaactcttaatacttaagcacagacagatcatacataaccaaaaaagaaggtcaagagtgcactcaataagctcttccgtcaggagcttccgatttgacagctcgtcaagttgacaagctgacacccgagcttcagagatcatctggaatgttgatgatatctgtgccctatttcaagccaagaactctaggccactagccagctatgaccaacacaaaagtggaaaatagcgcttccatacttggaatttaaacctgatgtattgtacaccttttttattaatatggtcagttaattttcttttagcaaatacaccctgctctatctgagacaactttgggattagaaattccagtatgattaagtgtcttttgggcaacactaatgtcaatatgattagtgtcttgtgaatactgtactatagtcttaaaacaaataattggaagaagtgggagaatcactcagatggattctttttcaggctttgatactcatcttacaggtctagattgttttcttccctgtcaaggtcatcaagaaggcaaattagccagagttgattctgatagacccgtcagccctaaacacctccagtcgttttgctagagaagctctgacgtctccaccttgtctccatgtgctggtgcttaaccaagggtcctgtttgcagttaaaaccagaccatggatttaaaaaaagaaaaagaagatatcaatagaaaatattctgttttcaaaacaactaaacaaaaaatctgacaatatataaaaaccctatttcagtggaattgaccttgtgatatttagtggtgccttgggcttgttgacattgagcagcttgttcacaaagaggcccagcaggttatttttccacttgttaaattttcagaatgtttcttattacatgcagtccagttcttgggtccacaggtcagttttggctgttataatctgcccttgctaaattttcaagggtaggagaattctctggttcttattctccttctccttcttccctttctttttccagtggtaaaaaaaataaaaagaaggttttttaacatctagtagaaatagggctgtttgtgtggccctgtcttggttaattctgtgcgtataggcctaaagtaatttatcagcaaggacttttccagatgcatgtaagtaacaaaaaatccaactcaagatggcttaagcagaaaagggcaggagtcctggatccaggtgctgttttgctgcattgctctctggctctccttctcttggctctgctgtcctctgtgttggctcttttcccaaagagcctccctctccgtgtggagagattcaagccaaattgctgtttaacttgaagttacaagaaagagaacctatctttccaagagtgtcaaaaaaaaaaaaaaaaagtcccaggccaggcatcgtggcttatgcctgtaatctcagcaatttgggaggctgaggccggtggatcacttgaggccaggagttcaagaccaggctgggcaacatggcaaaaccccatctctgctaaaaatgcaaagattatctgggcatggtggcagatgtctgtaatcccagctactcgggaggctgaggcatgagaaccacttgaacccaggaggcggagttcacagtgagcaagatcgcaccactgcactccagcctgggaaacagagcaagactctgtctcaaaaaagaaaaagtctcagtattacgttccatcagttccagtgagcctggattggatcaagtgtccttccctgagctaattgcaaaggggtgtgtatatgtgagagagagagacagagagagagagacagacagacagacagattgattagcaagacagaggtcccacaccaggggtggttttagctccatgtgaacaatgtggactgaggagtaaggaggcacctcctcccatgaacagccaggccgctgctgctagaagaggggctggtttctaagcaggcagaaatagcaataatgggcatctgaataaatccactctgactttggaattctgagattgtctgatggaaaattgctatatcagatgagtattgatttcattttttcatacttaatttgatgagctttgttagaatgccaggtttgaagaaatgagatcatggtgaaaaatcccatctctgatgtctatttcctctgtaaccttggacacgcttcttagctatgcagagccttagttttctcttcctagagtgaggttaatgcccaccccacatcattgttgtgaggcacaaataaaatggtattttttcgaagtgttttacaaactatgaaactatacgtttgggttgttttagaaattattgttattattttgagataacttctagttttcttctacattatgctttctcaactgcatctgggagtaaatgcattttaaagtaaatctcatgtttagctacatcttgcaaaactgtttctgttttccagcttgtaagcccaaactaatacctcttcactgacttggaaatcatagtttttatgaaagcaaacactgtccaagaagctcctattcatgttataacctagttaacactggtgctctttggaaaaggaattatggatgatatccatacttaaatacttttaaaaattaaaggatgtttatgagttagtgtatttcaaaatatttcattatatttcatttttaaatgtttgcttcttttttggtaaagtgtatgttggctatgtgggggcaatgcctcactcttccgtagtcattttttaattcctctaaaataaacactctgtaaatactgttgaccaaattactttatgtaaggctataggcatcataaaaccacagggctctacgacagatcagattggacacaaattgagatggtctccagttttttagggaaatacactgcctggaacaatagcgtatcatcggtctagcttaggcctggtgattcatcggcatcatcgtcagagccagcactgattagtacagctttataaggaggaaactgaggcatggagcatttatgtggcttgcccacggccacaaaaattaaaaggtacagaaccaggattccaatgccagcagcctagcttcacagctgtcgtgtgaaccacagtgttgatgaacaccccatattgtctctgcaaactgggaactagcggacgtggcacattccagaaattccaaaaccccaaatgctccaatgcaatgttttgagttccttgaaaaatcctattaagaatatctaataccttatgtaaatgcaacttcagtagagaattaaacctctaaagtagcatggataaacattgtatttgaagaaaatcctttgctcctgacatccaatttttcattctttacaaatcagagatagtaaacaattgcttcatgtaaagcattgtgaaatgatatgacctcctttctgtatgggcctctattctaatgaggtttgaatgcaggatcacaaaatttgtgataacttgcttttgtctgtatgcattaatagctagaagattcttctgtgcagtcagaagaatgcagaactgagaatacagatgaccaactgtactgttaaagaaaagcagagaattttaagatgagaaggggccagaaaatgtatgtagtcccatctcttaattgatgcaggcacccattctaatacatccttacagacagccacaagtttctgcctaaacttgactggaaagctggcccgctctttgtaaggcagccccatgattggaaaaggtctagttgatataacttttgccttatattgaattgaaataagcctccctataactcctacatagttcatgatatcttctgaaacaacaaagaatacatctgctcccttttgctgggaagagtttttttaagactgaagacaatttgatattttcccttcactatattaaatgtctccagctccttgccaatcccatgtgataagggggatgtgggccgtacagcatcctggttccccagctctgggcagatcaacattaacatgtcattcattcttactgtgcttttcttcatgaaaatttcccagcctttatcaatagctacgcctcctttctcagcagcgctggatttacattatccttttccagataaagcagtttttataaagttactcatccaataatcctagtctatcaagacctttctaagacttagttgccactcagtatatcagtgatccttttcaactatgtaatgtgctcattttaagaatcttacctcaaaacaacaaacctttgaagtcatccatcagtgtattgagtgaagtgttgattaaagtagaattgaaaaaaaaactgtgagctttctactagagacctcttagcttggcatcgttcaagaggattgttcaactgcaccttgttttttcatatttttcacaaggataaaatgaagaaatggtggggtctcaataaacatcattgaataaatgactctgcccaatgcatcttttctgtcagaagcaggaaacaaacagtcgggctccagttaataaatgaatttaagtaaaggaaatgacaacctcactttgcaagaaaggaatataatgtatattgtaaagagatgttacaaagaacaacattactttgcaaaatctaggtttttttcagccattcatgttatgataaaaagctgatcactgcctttctgaattagttattaatgttctgctttttagtggccctgaaaaacgtttgatagcatccagactttgaggtagaacaagtaaaacagcccatattgctataaacagcatgatcccaattgactcaaattccctgcaacatccctggaacctggggagctgcacaatgagagctggattgtacaggcaatgctcatttttttcctctgctctatttttttcttgtaaagggatttcataaacaattgtgtaatgccatttagggctacagctgtcatattagggaatacaggttatatattacctctacaaatgaataacaggaatatcataagcctatagttctctccttctctcctactttagtagccgaggacttcttttatgtgatatcagtcccagaattagagttaaggaaggaagggaaagagggaaagagggagggaggaagagaggaagagaggaaggaagggagggagggagggaaggagggagggagggagggaactggagaggaatgggaaagggaagggagtttggaaagggaatggaaggaaaaccttaaacttgggaagacagtgttagaatttatatcatgccagtggacttagatggaaccaaatgtgttgtttacttcctcccactcttggtaggttgattaatgctgactccagcaatcatgggtcacacgtgcagatgttgttagagaaacaactgttggcctggcttttccttcccagcaggtgataactgatctgtccaaaaatcctccccacaggcacaggggaaggtcacgatcatgaagttttggaaggattgcccttcagaaagatggagaaatggcaggaagcagcattttcttgactctagcatttcctgcaaatgaaatagttcagctgagaccttttataaaaagggtcagtgggtgcatgcataactttttcacactttagaactagaaataaatagacacagacagggaacttgagaagctaacagtgtggttgcagagaagaatctaaatcccatgcagttgttacaggactgagtgtgtatctcaaaactcactcaagaggtgagaaggaggagtgttcctctgtctccgatggtgggcaggaagaagtaatcagatgctggcctgcggcctctgggtaactcacaagaaacaaaaggctctaattttctgattttccaggcagggttcagttaatgcccacagaagaagcaactgtggggctgtcactgctgaaagaaaatatgcatacaaggtgtttggtgcgttaccccttgactgcactgaatttgtttgactccatcctttgacaggtctcatttcatcccagtctctgctcaaggagccactgagtttgctggctattggctaaggcttcctttgctgggatgcccttttttcttctgcctttgaagctgttttgtttgctcttcaagtctgttttcattttcttttagaagcactatcatccagaagaaggaatgcacttcattattccttgagctttcactctgaaactttcatatttcttgctggtttctttctggtcaatttctgaataccctgaagtgttgaaagtattatgacaaacataagggagaaacagagaaaaagtctttttttctttttttttttcagggctagaacacggcagaaaatttcatctctggtagaatctgactggagggctctattcataaaagtttctttattagattagctatataatatcagcagactcccagaagctttccagagcttaataggggttatcgagttgatggagctgtcatctacttgctctgttctgagacccaccatcagcctgtcagtcccagtttactactggttctgtccacggagaaagcaattttcatgccataaacgttgattaaaagcaagattgatccctactcactttgtgacccaggccttgcacacagtagatgaccagtaactacttttgcatgaatgtcagggtgacagggagataggttcttatgtgccaaacattttttacattttaaatttctgcttaaggccaggtgcagtggctcacacctgtaatcccagtactttgggaggccgaggcgaggggatcctataaggccaggagtccgagacctggccaacatggcgaaaccccgtctctactaaaaatacaaaaattagccaggtgtagtggtgcacacctgtaatcccagctactcgggaggctgaggcacaagaatcatttgaacctaggaggtggaggttgcagtgagccaagatcgtgccattgcactccctcctgggtgacagtgagaccctgtctcaaaaacaaacaaataaataaataaataatttctgcttgaaagaataattcttttatagagtggaaagcacagacttaatttggatgtaatatgcctagggaaggcttctctgaaaaagtgacattagaatagaacttgaaggaagtgagggagctagctaggcctatagtagccagagggagaacatgtcaggcagaaagagaagcaaatgcagaggctatgaggcaagaatgtgctttgctgtcaagaacccagacagcaagacgaagatgggtaggagaggagggtagggaggtagagcagtgtgggtaccagagaacggagaaccttgcaggtcattgttaggactgaattatcttctgtgttgaatggagctgagtggaatgacctggctttcattttagatgggtcattttggctgtagtactgagaagagatactaaggaggcaaggataacagcagtgagacccgtaagaagccaatggaataaatcaaacgagaaaagggagtagcttggagcaagtagtgacaggaaggtgaaattttagaagtagattcaataggctttgctgctggattgaatgcgagatacaggagaaaggagagctccagcattgtgaacctgaggaactggaaaaaaaatggctgccatttgccaaaacaaggaagctcacagggaggtgaggtcatcaggagcttggtctctgacatttaatttaaggttgagctgatttaataaatgcaaaaggagaagcatcaagcaggcagctgggtgtccaagtcttgaatttagggaagaagtctgggctggaaatatgaatttgggagtcacaactggaagagaccacctagtatagccaagaaggaagggaagactgaggactaacactccagggatgctcagataacaggaagcagccaaagaggctaaggaatggaggagtgatcaagggtgtcacataggtcaaggaaaatagaaaattgtttcagtttcagtagagtgggctcagatgaggacaggaaaagagaaagtggagaccatctagacatttctcagggagttttgcttaaagaagattagagtaattgagcaggaaaccgagggtgatgttggggcaagggaaggagtttgtttgcttttgatggaagatgttatagcaatttctgagaatgctccaggaaagaggacaaaccataatgaaggggagataatttattgtaaactactggatcaaaaaggaagtccacctttaggaggaaaactttggaaattggttatattctttttattttgtgattagatttgaatgcagttgtgttgtattttctgagctgaagtcatggtaaccgaaagtataagacggtaacaagagcgagacatgcattgcattttaagaaaacatttccagagctaagagagaggtctgaactgaagataaaattatacaccttcaaatgtgtgttgacttcaccatcaaagaagtaaacattaaattattggtaatatctcagttgtaagtctacctttacttacccctatttgtttgggtttcatagtaattcaggttcagaaaaactaaatgaggctttgcaatatatgtgacagggattgagagaaaataggcaaatgaaattgcaaaggggtgattaacattctttcatggaactgtttctaagctctacaagcagccttttgacacctaggtatgctaatgacaaatgttccttctctcttcggcaagctggcagccctttactgtctttatcaggaaatatgaggaatcttccaataggaagtcagcagtttctggtacaattaaccggaagtgtgttggcagtgacatagcttatgaaaggcacaagtggcaccaatagagtagaccagttaaaaatgataacggataacggtagtgactaatgtttgcataatgctttgccatttaccaaggccttttgaatgtgttatatgattccattcattcggtaaaaatgtgttccttctgtgttccaagccctaaacatttagctgtgaaaaagtttcctctctcgtgaagctgcacaacaacttggtgaaataagtaggtcaagtactattctccttctttacagatgaagacattgtaaagcttaattatggccaggcgcggtggctcatgcctgtaatccaagcactttgggaggccgaggcaggcagatcacctgaggtcaggagttcaagaccagcctgtccaacatggtgaaacctgtctctactaaaaatacaaaaatcagccagatgtggtggcaggcatctgtaatgccagctactcaagaggttgaggcaggagaatcacttgaacccgggaggcagaggttgcagtgagccaagaccacgctactgcactccagcctgggtgacagagcaagactctgtctcaaaaacaaacaaacaaaaactaaaaaaacaaaatagtttaatttggccaggtgcggtggctcatgcctgtaatcccagcactttgggaggccaaggtggttggatcacttgaggccaggagtttgagaccagcctggccaacatggtgaaactcatctctactaaaaataacaaaaattaactgggtgaggtggttcacacctgtgatcccagctacacaggaggttgaggcacttgaacccgggagagaatcacttgaacccaggaggcagtggttgcagtaagccaagattgtgccactgtactccagcctgggtgacagagcaagaccctgtctccaatgccaccaaaaaagaaaaaaaaaaacaaaacttaaatttaagactgggcacagtggctcacaactgtaatcctagcacttccggaggccgaagaaggcagatcgcttgagcccaggagttcaagaccagcctgggcaacatagcaagacctcctctctacacatttagaaaaaaaaaaaaaaaataggtgaagtggtgcatccctgtagtcccagctccttgggaggctgaggtgagagaatcacttaagcctggaagggccagtctgcagtgagccatggttgcaccactgcactccagcctgggtgacagaatgagactccatctcaagaaaaaaaaaaaaacaaaaaaacttaactcactacttttctaggaatttgggccccagatgaaattttatgactggtattatatttctttctcaaaacttttcaaaactcagtacttcaatacatgttttaccctgaaatgttattttcataaacataattaatttctactctggaaactcttggatttaaaaaattaattccagcactcagtataatgaccctatgtctaggagaagagccatttcatattatgaatgcagcagttacaacaggtctgccttaagtcgcttgctctgtgagcctgacaaattatttactgctaacaaaactactgcggtatctggaatgcatccgattttttaaaaaaataattttcatcccagcattttgggaggctaaggtgggtggatcacttgaggccaggcgtttgagaccaccagcctgggcaacatggtgaaaccccatatctactaaaaatataaaaattagctggatatggtggcacatgcctgtagtcccagcttctcgagtggctgaggtacaagaatcactggaacccaggaagcggaggttgcagcgagccgagatcgcacccctgcactctagcctgggcaacagagcaaaggttctgtgtcaaaaaaaataaaataataattttcacaactcaaacacaactgcttttaaactcttttaaattctgactttttaccacttgcactgacacgatgacagttacgcataacctaatgatggggatacgttctgagaaatgcatcgttaggtgatttcgtcatgcaaacgtcatagtgtgtatttacccaacgtgagatggtgtcacctgccacacagctgggctgtatatgatctagcctattgctcctcccaacctgtacagcatgttactatactgaatactgtaggtgactgtaacacaatggtgagtatttgtgtatctaaacatacctaagtctggctctagctttacttcttccaacccccacaaaaggtacagtaaatatatggtattgtagtcttgtgagacccctgtagcatatgcagtctgtcgttgactgaaacatcgttatgttgtgcatgacggtattagaaattatagaggttttactttctctaaatttacaacatagcttataaatagaaaatatttgttataacatctaaaaaatgtacataagccatgtatgaactctcagtgtatatgactaggggtaggttctttattcttcattgagaaaaattttatatgattttttttaatgaaataagtatggcgtaggatcctcttttcccttcttaactctggtaaatttctgtgagtagtgaaagatctattcactattggaagatctattcccaggatgctaagtgggaattttcctgtaggtactaagcactgcacaccctaaagagaaagctatcaatcatggagccagacacctagttcggggtttacaaggaggcagtgtgaatcctgccctgcccctgtcagctacctctccacataggcagaacattggttagtgctggagaaggacagggaattgtctgagtcctgtggaaagaactaaggcttttcctcctttgccatgagagaggagacagaatgcattcccgtgctctccaatcctggtgagaaggggtccaggaggaatgtacatctggcttgggggtgcctgcaggagggaaaactggccttggtatccataattggacttctgccaggcaggtcacatagcacctaccgagctgacacagagagtcttggggagggatgccctggcagagagggggagtgttcacagagcagcccgcccttctactgttctgtgtgacaaggatgtgtgtccatatcatgtgggccacatggatgtgcagaaggagtctggggttatgtttgtccccctgggtccccttcagggggcatgcatgtgtcctaggagggctgagtgggagttggaagaagtcaagctagaggcagatttctgccagcagaaactgtgcagtgggaggacctgccctctatcctagaagagctctccaaagaaatcacacggggacacaggagaacctaggttggagcagctgctacgtagagcacatgggagaccatgttaacgttagctgaaaagcagtgcggctgccagaggaacagccagacaagaaagggacctcgtccttttcctgtttcttcctccccaactaaacacatgaagtaggtagagcttggggcagggaacatccaaggtagaccatgacacctgccctcacctctcctaggagaagtcaaagcgcagaccgagcttctcttatccaccccgggctttttaagccccaagactgacacacaaggagggaaggaaaagtttgaatcagatatgagtttggatttcatacaaaatggagtcttcatgactcaaagtgaccaggaagtgatgcagtctgcccaaaaggttaaatggccttgtgcccatcaggcaggcagactgggcatggcccctttgggagtaaccaaaacaacctaaaacaactttttggtgtttggaccccagtgcagttaagactgtctcatgaactgattgcatttagatatacttgtgttaacttaaatatatatatatgaatttagtaaagtagaggagactttatttcttctaaagggttacagcctgcaagatggccatcccgcaggctgggaagcacctccaaccaagaccccagagacgggtacttcgaaggaaaagggcttaggtagaagatttatgctgaacagattagctaaacacatatattcaatgtgttacaagagctgtgaatattcatgaaggtggtcctgacacatgtgtattgaaccaacatgcatgtaacatgtggcctatgttcactttgggttggagacttaacatgtagatatattacagttagccctgttcgtcagaagggcttttcaggacatgaaggcacacaagtgtgcaatctctgtagaccaaccagaactagtccatggttagtaatcttatttggataaagttactgaatcaatctcttgtccagctgtagttatggctggtggagcaggggctaagggtcaatcagcatctggtggaggtgcaaattgtttaaatattgcttctcttaaggccagtacctgtttagctgctagagaaaaagaaaaaccttgtggcagttggaacatagtttattctttaggtataggggtgcgtgacttaacctttgcctagcatggcctcgggtcctgttgataatttggtatcttatagccacaaagagactgttctgtcactcttatgatgtctattttaacattaattccgatcagttgttgtgtctaaaccatgaaaaagaggaggtataatgaggcttgtctcacctcccatcccatcatggtcagaaactcaattttaaggtttttctggggtccccttggccacaagggggtccgttcagtcggtgagggggcttacgattttatttttagtttctgttcatttcagggtcagtagaaccaagctgtatatagctggagtggccctctgccttctggtgacatcagtaccaggctcacactccttcttagccatcccagcaggctgacacattgtgccactcacctgtgtgacctgagcaagccacttcacctctttaaatgtctgtgtcttcatctatcagatgacaggtggtctctggattatttagcactagaagtgctagaagcacttctagcactagattaacactagaagtgtgtgaaagttgcagaagatgtgatttgtgtaaagaattagctcaggactgggtgaggatgccacttaagatggtaatccagctaacgcatggagttagtacattcaaatcagaggagagctattggagacaaggccaacagagtgaatgggtctaagactgaacttgctagaaaggtaagaagaggaagaaccctctatggatgtataaaatagcatgaagtttagagagggaactgaggatagcagagctggtttaagtgaaaggtgtttggaagtgcctttggtcagaccctggggatctaacttccttaaccatccccagcaagcctctggttaacagaagacatggaaagcaaaggtgtaggggtgtgtggagatgcagttgtaactagagagagaggtgttaaattgctggtgagcgtttctggggtgaggaaacttttagctagggataagccttcttttctatcatttgtttgctgatgatacagttctttgccgggcctcttaaccatattatggttatgtgcttgccttcttcctgcagtgatctttgtacggactgcttgtgaatgctaaagatgctcacagagcttgctgaataagtttacatgctctgccattttctgtgatttaatttcacagtgtcttttagaatgatgaaattcgggaacagaacttgggatgggtcaagccaagagctcagtcggtctctttgaaggtttctactgtaactcctgggaagggatgctggttagtttagtgtttggttctgagcaaacattactgataagtttatcttattaatggtgtgggggagagccagaattatggagctgaatcattagactcccaaatgctgttcccaagggtttctgcttgaggaacagaactgaatttccctgacttcagttcttccctgccccagcctccttcctgccacctccttcactcctcccagtgctgggtagcaagctgacacgtcttcctttgttaactaccgagttttgcccgtaagaactctggaggcataaatatcttctaggtttgtcaaatagagcaatgactaaatcaggaaaagtcattttattgcactgtttgctcttggtcattgaagataagaaaataaaaatatcggacctgtgttaaaggttttttcctgtttttcctgaagttgatgaaaatatttatcctctgaaagtagtgacgtgaagggggaaggtatttctggttttccggcaaatataaaatacagtttgcttttttccaaggcatgaatttattggtaattttccttgcataaatgcataaatgatttttttagtcaactcaaaatgttttaaagcaaaaagaatgacttggaagtcaattattaaaccttgagcaccctaaaacattttttgagttttttttaaatgtgattctttgcattttattattttcctcttttccttcctggatgctaccttggtagctgccatgttttaaatattgacaagataagatagttttctgtttatatcagcagtcgtctgtctgtgaaatatggacgaatcagaacgcaggatttcctttctcagcgatccatcaggttcataatgtaaggttacaaatggttcttttcttctcctgaacttgcgctatgtactgtgttgcacagtgttgtcaacagctataggtactgtgtcctggcaatgcagaaaatttgtaatgtctggtgactccgagactctttgtctattatacttcatttactgtgccttgtgattagttgatgtgcaaacattgtcctaaaacaagaaacatacttggttttaaagtgtatggttaaaatatgtcccatgtgagttttggctttcattccaggcgtctgtgttaaacttgcttttacaggaaaaagaaaagggtaaattgatatatatatatatacacacatgtatatatcagcattattcctccccattttgtacctccccatattcatggactcttcaaccctttgtgtctaatgattctcaaagattcatgtgcttcacttgtgagaaatttctgagtatgatttgcatgttattctgtatacattttatgcaaatgtggggggaggtgagctgggagaggcacggttacagctacaaagtggttctcagcctttttccatttgacagtactgaattgatctttgcaaattgtatgaaattgtgacccattttactctgagctgcatgattttcaaatgttcatatttcacctttgcatactttagaaaaagtttatttctatttggaaaataaacatttaaatgtttggggttttatgttccatattttaaaatactattctattttcacacccttttgaatttctcccattggatagcctgctgtctgagaggttgagacacttggttgagaatcactgagcagattcttggggcggcatgtgaagggatgccacgggtatttttgtgaagtgccttttgggatgctgcatcaggcacatatgtactcctgtgcatgggacttctggctcttgaggaccatggtgtctatacattgcctggtactggtgttcacgtgacccagcagttcctcttggactcataaatgttaaccagagcttttatgtgttcgtaagtagccatctctgctctttttcatctaaaggaacaaattcagtataaccaactgcatttgatcaaactagaattcttcattcttgaagattttttgaaagaacaactacaacatcctgctttcattatgtgtgaatgtttatgggaagccttttccttacattcactttcaaatatacgtatgcatatttataagcatagagctgtgtatagcattcttcaaagccttagagattacagaaagtaaatgtaatcacatatatcttatgtatgtttgggtagcccatctctgaaatttgtcataattattgaaagtaaaaccttaaaacaataattgtcctttaaaatcattttagtttttcattaagtgttctgaagaaattgagactaatgtttgttaatattcagatctaaatttataagcaagtaggtgggagcagtcctcatagaaaagattttaaaggttctatttttaaaaatcaattaaatcctaatttttaaaaattttaaagaataatacaaggcttggaaaatgccatacttttctattaatgttagaaaagtaagttgtaagcatggcttttaattatctactgacatccttaggaaactttttccttaagaagaaaataacataaaggcctggtagagtgtctcatgcctgtaattcccagcactttgggaggccaaggcgggtggatcacttgaggccaggagttcgagaccagcctggccaacatggtgaaaccctgtttctactaaatatacaaaagttagccagatgtggtggcacatgcctgtagtcccagccacttgggagactgaggcaggaggatcactggaccctaggaagcggaggttgcaatgaaccgagattgtgccatcgcactccagcctgggtgacagagggagactccatcttggaaaaataaataataataaagacggaaaataacatagagaagggtttttcctttctattctcagagcatatagaatatgtaatattcagtttcccttttggagggagacagctacctgatacaatttgttttagaatttgctgtaggtgtccagtgcatgtgaactaaaaatttgcagctatttaccacctgttgaaataatgcaaagtttaaaagctgcaatttggaatctgccatccagtaaaaatctctgtattttgtgaagctttttgttttttaactaaatcccattgatgcttttgtatttttcagttgttggtataagagaatgtttaatttaattacattatattagatgtggcccaattatagtccttcagactcacccagactacagatttatagttggcagttgcaaacatgtgttacacagaatcaattctccatttaaaattctaatgtcaaagtatttttcctttatgttagaagtttagtttttatttgagtttgaagaagagagctaatgatgtacattttcctctgtttaattgatgttctttagtgtgcttaataaaaaaaaaggccttaagcatacatataaaaaataataataaataccaaataaatgaagttttaagccatgacaaaattcttggaatatgaagatctttcaaatacatgaacctaaaggaaagattttctgtaaatattttaagtgccaaagagatagcctgaagacatttattaggagtaccttgaatcattttgatttctcatttgtgattacttaaggaatcctttcaaagaccactgtgtcaataataatttaaaatatgacagaattctaccctaaacttttcctacttcattttgctattctaatgaaatattgcgttgttagctgtgtttaggtctgcttttcattaaaaataagctttgattataaaccattattgtggcaaaagacttcttaggtctgttatttaatatttaataaggatttttaagtggaaaattactaaatttaaaaatatttgcctgaggagatgcaagtattatgtagacatgaatgtactagtcaacaagacctaacactaggcttcaaagttcaaaatgattttatgtatgaggcaaaaatctttcttttttgacctcttcttccattccatatagtaactactctacgtaattcctccatagctcattcctgctgtaattcagcctccaggagggttgagacctaaggcacccttgttctctgaactcttttgttcttactgggagtcaaccaggtacagctgaatcccagccaagggccaaggtcatacctgtcctttacgacagtgtaatgttaagtccagttgttggagtccatccattcccattaaattaattccaaaaagaagaattaacatctacaaattgagtcttctaaatacttttagatctaagtttaaaaaaaaaaaaaataggcaggggtggggagagaagttgatgaatttccaggcagaaaagaaatttattttctaataaattcaatcttaagaacacctttccctctgtttaaaaatgaatttctggaaatagcactaaatctgataaaattcagtgtctctttccagaaaggtagattcagtccctgtagggaatttgacaatatttggactgaagcaatatttgaaggccacaaagaaaatgaaataagtattatatttcttttccttgtaattatctcccaccttagcacctagggaaaatcctatcagatcactctgaattcaaagcaagtggtttgtgattttggacaaagtggagtcatgggagagcagatgatggcgctgtctaaacagatttaagtggatgttccactaatttcttccagtggttatcaaataagggatttcagtgatttccagaccgagattggaatgtatgtgctggggcttgttattcccacaatggctgctacaacttatgtggatgacgtaaatatttggatcagcatttggctgtggctctggctttaaatgtatggaactcacattaaagtttaattataaaagtgtgtgagttaatggaacaattagagaatgaatttgcatatgatttgcatgcttaatgtactaacacgtgaaatgttttcataaccctagcttcccccaactcattcccacccccagccctgttcccagccctggccctgcaactcatggcaccaccagctcatgccgtgttcagacttttttgaaaactacctgttgagcttggccaaggtctacctctgctgaactgtaatagggttcacatgaagatctgatgcttggtttgagttgtcacatcagcagacactggatcaaaggatctttggaagccatccagatcctccttttgtatcattccacggagttgcatgcaaacttctgttgttttgttaacagtgttacctgtgacttaaatgtacaatacctgtttgccgtgttgttgttgctttatccagggagcgggagaaggagggagaagtttaatgggggagattagaggatgatttgatagatttgggtaaagcttttgtttaagaacccatagctgcatgtttccagaattttaagctattatcacttaaaggttattacactcagcttcaaaatgatattgaaatccacgtatcctatattttgaattttatactagtttttcaaaagtaagttacagccagatgaaataaagaccagagagagaataaagagccagccatttgagaaagaaggaaaagaaaaaaaatcaaaataagaagccaaagaaaaacttaatctaattttagaattgcagtcagttatcacttttacaaactaaaaattcatataaatataaaagaaaaactcaagaatgagtcagggatggataataaaacagacaaaaatgctaaagttaatattgcaagtaaagtcttaacaataccaacagacaatatacatgtaacaaaatttcacatataccccataaatgtgtacaaaaataaaaaataccaacagacagggaataggaggattaagcaatgtaaaagtaaatcagcaacgaaaacaaaactaatgtggagagtggctgagaacagagcaggagagaaaagccgaaggagttccaactagtcacacactaactacagtgagaagccaaggaaatagcgtgatgctaactttgctcttctgcgagtcgaagtgacccatctcaaggagaaaagcttcaggcactccactgctaaaaaaaaaaaaaaaaaaaaaaaaaaaaaaaaaaaaagcctgtgcattactgaagtcctctagaaagggctttttatcattggcagctacttcatatgtcacctaatgtaagtccaaagtgcgcaaagaaaattggagagctagttctcctccccaaaatatgcaccctatgtacgccattcctagagaactgtggttcttaatcttttggagtttctagattctttcaaagaatttaataaagcagagaacttcctttctctcccaaaacatacaactgcatccaaaattttgcattcttgtcctagactccttaaaaattctccttaagaaatcccacagtgtgtcaacacactttctagcacttctgtggaacttgttctctaaccaaggttttatttgattttggagtttatgagacctttttacactcttccaactcctgagaaaagtaatttctcatagttctatatatagccaaatctaggttagaggagagtcactctagaaatctgcctatttagttttagttatgtccacttgagaacaaagaactgagttttggaaaaatccaaatctttcccaggagaaagagtaagaaatatctcatgcgtagtatgtaaatcagagtagagcccagaaaatacctgccaacactggcctttgactttatagatgctcacattaagctattatactgatgaaacaggttgaggctaacctcatggaaaatgataaatgaaatgatgggaggtcctcctgttttaggtctgtatcatatgatataccatcatttgggaatgtgcttgtatttgtgaatcagaatcctcaaagtacatgcctatgtacatgtgaccaaacttggcatttcactgtttagtcttcattggtacgttaggttttctgagaaaagtagctgaatccatctgagacagcatcattaaatcagtgcaattgaattcagatgagagaaattagtgtcacccattagtaaatttttcttttaaattttgtttagcatcatgcttacactaccatttctccagagatctaaaattattcaaagtggctagtacatgtcatatttgggaactgaaatttatagaactgtgtgttctgaatgtgaaagcaattcaaactaaaaatttcagtcaagtttaaaaacaaaattcttttaaagattgtgtgtcctttgctgttgtgatggaaaattgtgattagtaaatcatttatgaatatcttcatgttttattttaaagtgacttagcttaggatgtcattctaaaaatagaataattcaactccacacctcaaaaattaactcagccttgagagatatgctaatacatataaaaatgtaataaccaagtatttatattcacataagacacccaaatgcattttggtacattcacagcacctgtgtgtaaggtgagctcagggtagctacagggaatgaactttgctgactgctcatattgcctctagaataaatgtcattttcagacaggagactggggagaaccttccattaccttgcgacctccgaatgaagccacagcctctaccccggtacagtactggcagcatcacccagaaaagcttatcttccagtcgtgtgattacaaagcttttgtaagttaccctcaattcagtatttgggcctaagtggagatagggggtatgttttcagcttgtttgcatttacattgaaaatataccaaaatatccatatccatcactgaaatttttaaaatgtttttctcttcactttttcttaaagtagccttctatccaaagagaaagtccaaataactagagctttaaaaccgttttaatcttgtaagtttaaggtctgttgtgacctcttatatagttgtatatttttaaataaatgttataacgtacaatcttaaaatggaaatgagtgtaaatatggcatatatatatatatatctctgctcactcaccaaacactgggtctcaaaacactgggtctgccactttatgtaaataccagattcttttcactgtcatcaataggattatactatttttctgttttagttgtttagtttagtttggtttagtttaggttagttgtttagttttttagaagaggggaattaattataattagctgagaaatgtaataggaactggtaaatgttcaaaagatactgtaggttttgggtcaggtggtggttgtcttgacgacagcagaaaaagtggctgaaccttcagcagtgcattgaaactgcctctcttaaaaagaaacatttcaatcaggcaaacttccctgataacttaaaagataaggattttaccaaaagataataaatttcaccttcatttgatttagatggacattgtggttatctcataccagttgagctttttttttttttttttttcattttctgctttctgcccctcttttactaaagcttacttatattgcagctttggatttatttcagtggtactgcccaaaaccataggattgaaatggctcctccctccaaaccccaagtccccaagcctttctgaacatgcctttctccaaggccctgaccacgccttctgctgttgtgccctctcacgtcttcttcaagtcaggcacttccctagtccacaagagtggttcccatccccgtctctgcagagtacaagtctccagtcttgtcaggaagtgtccatcagatatcttctaaaataattattgtaattcacttttttaaaaaacatatatagagctctttgggggctggtggggggagggcaaggggcaggggaatgacaaaaggcaaaaaccctactaaagcttcaaaaggttgaaggggagtcaattgatagaaaggcaaatcagacattttgtttaaaaccatttggccccagccagaagctggagcacgaggggcattttgtaccaggatgatacagtatggggtctggtcttctaacaacaaagtagttggcaattcttgggagactgtcatccttctagctccattcagccctccaggtggcacttcgcaccaggaacccagctctcttcccctgggaaacaactgagaatgcctctctccctccccccaccctcccatcccgttctcaggtggatcaaccatagggcacacagctgtgaatgaaaaaggtccaaaactgcatctctgcctaaaagcctaacattaattacctatgcagcagaataagcctaaatgggggacatgttgcttagcttctcagctgtctcatgcaaccctgtaattacagagatagtagtgtgatttatttttgcagacattgctgcctcaaaaaaggggaaaacatttttagatgcccccattttgcagttaaatatgatttgaaagatggcatctttagaagatgttgcagtttcattataaagagcaattacagcccccagaacttatggttaattctgctgcattttctctatgaatgcatttatttgttaggattagttactgtcagttttttaaagttatgcaacaacttacagccaggaaacctagccagtaatacttccacaatttgtttttaaaacattactcatatgtatattccatttcataaatcattgaattttttttgtattttagtatttaggttctatgctgataaaagagcttagggggacagaatcaacccaagatgcttgtgcaaaaatgcgggtaagtctgccaaactactttatttctagtagctgaaatactaaatactgggtatggatacaaattgccacctttcaaattactattttctccatctgttggtctgctgaatcacattggtattacataaaaaggtgctcttgctttctgcatgtttatgcttgaacttatctcactatagtttgagttaatgtctatttgctatatttgtactatatttgttcttaattatttttaaagatttaaaattaattgtatcattttcgagattagaaaaatgatctttattacaacaaaaggttttaagcacgcactgaatagtctgagaatatttactgaaaacatcaccaattgactaaaattatcaaaagcagaagtattaagagcatattatataaagctaatattctttatgcaatttcttactcagttttttttttttatttttttaaattcaactttgagtggaatgaactatttaagggcaaatgttaactaaaaatggcaattccaggccgggcacagtggctcacgtctgtaatcccagcactttgggaggtcaaggtgggtggatcacctgaggtcaaggagttcaagaccagcctggccaacatggcaaaacccctcttactaaaaatacaaaaattagccaggcatggtggcatgcacctgtaatcccagctacttgggaggctgaggcaggagaatcgcttgaacctgaaggcagagcttgcagtgagctgagatctcaccattgtactccagcctgggtgacacaagtggaactctgtctcaaaaaaaaaaaaaaaatggcaattccaaatatctgtgattagtggctgcttgattcctaggagtctattttagccaaagcaactctaactcgtattgcagacccaccttttccttttgtacgtgtcccttgttcttgcttcctccataacaggtgtatagaggctatgctggtatctgagtaactgcacaaattgagaatatcagacttgttcaatatagcatctaactaaagtcaaatttaaggtcattagtaagtgcaatcctaacttttatttatggccaatataccttgttgtttattttatatgagcagcttttggtggaaaataatttaagagcatataattacactgaaacagctatgaaggtaaacatgaaatatccattgtttatggaaagctaaatatgtgtgaatcttcatgaaattgagacttcaatatgtaatcactaatattttgatcaattcaacagcaaaaaagactgaaatagttatccttctatttaatgcagagttagacagtacttaaattgtcagtaccagtgaatatttaacttaggtactgagtttagataaaaaaacaagcttctgtatatatcagaaactctaagttttagttccgtggctggttatttgccttaggagtcacctgttattcataaaaataatatgatagctgctaacatttactgagtctttacagtgtcccctagtacaattattgtccccattttacagacgaagaaatggaggcttacagaggttgaataacttgctcaaggtcacacagggaataacttgccaatctgagactggaattcgggtctgtctgactccagagcccaggcttttaaccactacattctcctgtttccccgatcctctgttttcttacatataaaatgagaacattagactagatacactttagagttctccctggttttataattctggaaatcttgtattctaaatatttatctggcctaatttgtgtcaccaatgaacaataagaaaaagggaaagttttcattcatcaagcctcataataattttagaaatattcatgaacatgtctaataaattaattgggcatctctgatttaatactcttaactaaattacctgagaccagctactccggtgtgataatcagcatcagtattgcctagtgcatgcagcatcatttaaaatataccagatgtatgatttgaatctcagtcaatttcatgaaattgagtggatctgaaattacatcctgatagcaatagaaaagccattttagtagcctaagtagagaataatttagttaaatccttgtctgttgcttaaaatgaaacttagaaaaaaacatatatttagaagccattcttctgttttggggggcatttttctggtttgctgctcttggtgcttatgtagtttacatgaaaatagaaacttcattacttctcggactatcataaacccttatttccaatcttgattaagtaagtctcagttcttgataaagtagctaaggttgcattcactacatttcaccagagtctttcaaaaccagaagcatagggttgatctgctatctggaactattctattgtgaattagaactttcaccaactataaatgatgtagatctcaacttgcagctaattttcagtttgaaccccaagttgctgttttctctgttctcagcatggtggcatttcagccaaaagtcccagttcaatcaaaactccccatgaaaaatactttaggacacagacggtctaaaaagttgattcatggtaatattattaggccaaagtattgtagattaagagttacctgtttattcttttaattgaaaaaaagatgttttctgttcaaagtatgcattttagccaaaatgaaaatgtctctcccagtaataagtaaatcactgtggttcccaattctgatcaatgtttccttaaatgtactttgttaacaaagatgactaaaatccaccgagttcacaatccagtggaggaaaccaacatgtgaacatttaattaccccaaagtggtagaagtattaccatagaggcactttcaagttgccatcagcctaagggatcataatagacgatcttaaaaatgacatatactcatgccctcctaaaatcagtttattagggctaataacaggtagcagttgagagctgtacaccctgccctgcacaactgaattatgtgcattagttcactcagtccacacagtaggtattgccattgctcccactttacatatgggaaaacaaagtccaagagaagttaagtcacttgcccaaggtcacacagacagcaggtggcagagccaggatttgaaaccaggcagtccactccactacccacactgtgaatccagagactggactgcctctccaatgtgccaggaacattcattgccctgggttttgttttttgttttgttttgttttgtttttttcactttttaaatggcttattttatgtgcaaataataaacagatgttgtacccagaaattctactttccaaaaacaggagctttttaaaagaaaaccacataataacttttaaaaggcactgggattcctctgcttctagatcattgctaggctagaaaaataaagtttgttctaccaggaatcacaagttagaactgagtattctccagagtggaaattctagagtgtagtgtgatttcaggcaaagattattcagttctcatcctcgacatccacaactacctatcagaagggttaaaccagctcaaaacagtccagcataattaggcttcatcaaacaatgtcattatgctcttctaagatgcaaatgaagcaaaacaggaaattctaaaatctaaataatatttgacactgtcatacaaattgttagttccttgttgtatcctcccttctataacattaataaagggaatattttactgcaaagaatattttattttatacatcactagccatgaatttttgccattagttattatacaaatgctgcctagtgccattagatggcaaggtaggaaaaatatattttaatcatttttcatttaagtggccttatgtaaaaaataagctaataatttagcagtttcaagtctccaaagggcattttcaaatgttcataaaagaaatggttacagagatttttaagaagcatcttccatgtccacatcctcttgtagctgctgtgccattttctcttccaactgcttccctttgcctgcaagaggggctcggataagatggatgttttgcttgacttctttgatatcctgaactttctgtagctctttatttttcttcaatctgttcattaagcttcgtgtttctgtttgatctcttcaattctcttcattgcatcagtagttttattccatagctctcactggtatttgataggttcatttctacggttttcaaattcaaatgaattatccactgtaagctctttaccagctgctttccagaatgctttggtccacctaactttgtgaggatcgcacttctttttaaagtttttaatgacatttagatttacaaaatctgaacaccttgcaatcattgcggatgaacatcttgccatggccagggtggatgggccccagacagaaataacacttcttgatacacatgttgaacccccatgggtccccatcgaccaaacgccaagcttgccaagcttgagaggaagtctttttttttttttttttttttttttttttttgagacagagtttcgctcttgtcacccaggctggagtgcaatggtgcaatcttggctcactgcaacctccacctcctgggttcaagtgattctcctgcctcagcctccccagtagctggggttacaggcgcctgccaccatgcctggctaacttttgtatttttagtagagacggggtttcaccatgttggccaggctggtctcgaactcctggcctcaagtaatccacccgccttggcctcccaaagtgctgggattacaggcgtgagccaccgcgcctggccaagaattaccacttttaaataatgtgtccacaggactggattttacaaagccataagtatattgctttgacttttcagtgggtttgttgttgttgttatgttggtatgaataactcccacttcaaagattccaagacatacagtttttggtgaagtgaaggatttgctctggccagatgaggttctgctcttcaattttgcctccctaggcttacccataccccatcccgaaccctgaattttgccctggggcttaattttcactaatatacagtaatgcatcacttccctaattaaatatacaattaggaagcatctgttactgtaagaggtaagccattatattcaatttaatactctctgcagtcttacgttctctaatcccatagttgatggttagtatcattcacaggtgtttgttctcaaggaaatttctcttaaaaagtaataaaaataggattatttgttgttttgctattgcaatgtttgggtcccttataaattctggatattaatccttgtcagatgtatagcttgcaaatattttctcccattctctaagatgtctcctttgctgttgtttcctttgctgtgcagaaggcttttagtttgatgtaatcccatgtgtctatttttgcttttgttgcctgtgcttttggagtcatatccaaaaaattctttcccagtccaatgtcatgacgtgtttctccagcgttttcttctagtggtttcaggtcttatatttaagtctttaatccattttgagttgacaaataatcaactttaaaatgggcaaatgaccagaatagacatttatcaaaagaagacttacaaatggccaaaaagtatatgaaaaaatgctcaatatcattaatcagtagggaaatgcaaagcaaacccaaagtgaatcactagggaaatgcaaagcaaaaaccacatcttactccatttagaatggctattatcaaaaagacaaaagataacaaatgttggtgagaatgtggagaaaagagaacccttgtacattgttggtgggaatataaattagtagagcaatgatggaaacagtatggcggcttctcaaaaaattagaaagagaattactatattatccagcaatcccactattgggtatatatccaaaggaaatgaaatcagtatgttgatatctgcacctccatgtttactctagcactattcacaatggccaagatgtggatccaagctaagtgtttatttaaaattgtgtccatcaacagatgaatgcgtaaagaaaatgtggtatatgtacacaataaaatactattcagggaaagaaaaagaatgaaattctgttatttgtgacaacatagatgagcctggaagacattatgttaagtgaaataggccagacacagaaagacaaataccacatgatttcactcatacatggaatctaaaaagttgatctcatacaagtagagaatagaacagtggttatcaaagccaggaaagggtagatgaggaggaggggaatagggagacgttgctcaatggtaacaaacttacaattaggtaggaaaaataagttctggtgcccaattgcacagtagggtgactgtagctaacaatgctgtactgtatacttgaaaatagctagaagaggattttgaatttctgaaaacaaagaaatcataactgtttaaggttccaggtatgataattacccctatttgtcattacacaatgtatacatatattgaaacatcacattgtgccccatgaatatgtacagttattatgtgtcaattgatatttttaaaaaataatcctccccaaaaaagaaatatctgttttcaactaagatgaggtagaaatctgccttcctgatataagaaaggaaatattttaagattatttttaagtcagaaataagcaaatctagtgtatttaggtcttggaacttttatttcccaaaggatttggatagtttccccatagttctcattgaatctgttcctcttaatttgtatgatttttaaactttcaatccagaagcacttctaaagcgtgaattttcaaatatacaaatttccaaataataatccatgccctagttgaagtattaagacttttctcttttttatgtgttttaggaaacaatagagggaatgggttggaaaactttgaaaaagttagatcttaaaattagatggaaatactaaatgtaaaagcctctttcctcttagaagagactcaaactaaaatcatgttttgttcctctgtcctcatacaaattccttctgtgacaagttgtcattttcagatataacttcaagaattacttcttaggaatcagactgggaaaaaaaacttttaaacaactatttttttaaaagtctctgttgagctgggcacagtaacatgcacttgtactcccagctacttgggaagctgagtcaggaggatcacttcaacccaggaatttgagactgtagtgtactgtgatcacacctgtgaacagccactgcattctagccggggcaacatagccagatcccatctttaaaaaaaaattctctgttgcccaatttcatggaagcatcaattattttctttcactctctcccaaatactgcgtgagtcatagtgaatacagcttctaagcccataaatgtgtgttgtgtgtctattgaatcgcaatgcccacaaagaaacagccacataggtaactccttattgctgatccttgctcacatgtgcctttcccattgtgaatgttttctttttttttttttttgactgtctcccaggctggagtgcagtggcccaatcttggctcactgcaacctctgcctcctgggttcaagcaattctcctgcctcagcctcctgagtagctgggactacaggcatccgccaccacgtccggctaatttttgtatttttagtagagacagggtttcaccatattgaccaggctggtctcgaactcctgaccttgtgatctgcccacctcggcctcccaaagtgctgggattacaggcgtgagccaccacgcccagcctctcattgtgaatgttttcttacgggcctactctagaaggctaaagagcaccaaccatcttattccatattgtcttcaaaccccagttctctttgttattttttatagcccttgttgctagcttttctcccatataacacccttactacttcacatcactgaaagatttcctgggctgcttctgtctttaattcccacttgtctcaagctctttctaaacatgttgattgattgagtctcttctcattggcccaggtatattgatccactgaaagttcattgttgcaaccaccatttccctgccatcatagcaagtagcctggagagtgttcagttatgcacacagatttcaattttgtttctgctctcttttgccagtgctttgctttggagagggactttctaagtgaaagcatctatcctcagaataacaataacagctggccgagcaaggtggctcacacctgtaatcccagcactttaggagactgaggcaagaggatctcttggggccaggagtttgagaccagcttgttcaacacaataagacccccatctctaccaaaaaaaatactgtttttaagcagtaatagctaaaatctgttgatgttcactacatgctaggcactgaattatcctgtacaatcctcacaactctaaaatgtagatgctatattaacatacccgtttacagatgaagtaactaagacacagggaggttgagtacctaaccacgccgcaaggaaggaatggaactaagccaggaatccaaacataccctgtactctcatttgctgacaactacccctttcttctcagaggaaggagctcctcagtgggtcccttcataagctcaagatggctacacacacccccaaaaaacacagaagttgcacttataagtgatagattcaaacagtgtgttttttcacacatttgcaattggcatttttaattaaaatcatacatttttaaaattttattacaaaagcaatacacgttcattactgttcacttctaaaatagaaaaacaggaaggagaaataaaaacaactgtgattttaccacctagaagtggtaaattcctccctgttaacatcttatgcttgtgtaatcctccagaccaattatttatgcatttgtaggtactatttttctagtaagaagtggaaatattgcatatccactgttttaccgtgtattttaaacacaataatatattttgaaatatttttattcctatacatattcatccccaatatcatttgtggtggttggttacaatattccaatccatagttgaaccaaatttatttaaccagttctccttgttggtcattctgtcatttccaattcttttcaaatgatagccagtactatgggtaacaccctttacctaaatcttttgcagttggtttgattatttccttagaatgagccactagatatagaatggctggatcaaagggtatacacactgtgaaactttggataactattcccaaattgccttctagaaaacttcttccagattacactcccaggggcagtacacaagcccatgttcatgtttgcctgtcacatctctcaagagcatgtgcttaatttgagggagaataggggaactttaataaaaaaaaaaaaactatacatcttcatcttcagcaagacccctgatcttattaactctatcgttgttttttcaggttttttgtttttgtttttgttttgagtctctctgtcgcccaggctggagtgtggtggtgcaatcttggctcactacaatcactgccttccaggttcaagcaattctcctgcctcagcctcccgagtagctgggattacaggcgcccgtcaccacgtccagctaatttttaaatttttagtagagacggggtttcaccatgttggccaggctaatcttgaactcctgatcttcagtgatctgcccgtctcggcctctcagagtgctgagattataggcatgagccactacacccggccaacatctattctgggtacaactcttgaatctgtcattatgaactgaactctttgttttatgtgaagaatgttttatccattcacagtccctgagaaaccatgaagaattaaataattcttgttaattgctctcaagaccaagagctgtagctaaatgctaactaaggatttttggaaatcacttgtcaagtggagaacagtgtgttttgataaactagattctttctgaattaatgtaggatgcagtacagcgagtttacatgcacagcagcagagaacagttctgacagtaactttcaatcaaactgatcgaccgcatttttagagcagtagttctcaaagtatggtctcagacgtgcagcatcagcagcatatagaaacggagggcaccgctttgtgctgtgccagacttgtgctccagagcatgtgagttacacaggcagtacaatggccatgtcatatgcaggaggtgtggtttcaatggctgcttgcccactgtctgttcttgtcacctggtcttaggttctgtattccctcagcctttgtgccagacctcctatgaccagaaaagtccttgcaaggtcatttagcctcattaatgacagatgagaacccaaactatttttaaagatgtctagagggggaaacttcccagctgcccttaggaatccttctaccctgtcaagaaggcttttcttcttaatgcttgcaatttgagccagtttgctttgcagaaacgaagacctaagccttgcctccttgagactgaaaactctcatgatctttttttttttttttgtctgttttcttctcttttctagagatggggggtttcaccatgttggtccggctggtcttgaactcctgacctcaggtgatccacccacctcggccttccaaagtgctgggattacaggcgtgagccaccacacccagccaaaatctttgaagttttctccaccccataggaatgtcttggtaaccctctaatcacatttgtggtcctcctgcaagctttgcaaggcctctttgctggctctgggtaccagagctctctgaaagtttgctgagctctcagcgtgttgagaggctggcactgtgcttccttttttttttttttggagatggagtcttgctccgtcacccagagtctcgctctgtcacccaggctggagtgtagtggtgccgactcagctcactgcaacctctacctcctgggttcaagcaattctcctgcctcagcctcctgagtagctgggactacaggttcccaccaccatgcccggctaattatttgtattttagtatagatggggtttcactgtgttgcccaggctggtctcgaactcctgagctcaggcaatccgcccacctcagcctccctacgtgctgggattacaggcgagaaccaccacgcccagcctgtggttccttataacgctggctacgtgcttgttacgatacattaattcactggcctgttcctttaacagtcatggagttcagcaaccattagatcgaatcctatgaaactgctggtacttagccattcttgacttgaaaaatggctacttcatagggctcaatgtaagaccatgtgctagtcattacagtgaagacaaatcaagaaaggtgtgggcagtcctcaaggagctccctatagggaagcaagcagaccacgctgagacccagggcagtgcacgggaaaagtggcagagaggggaacaagagaaaagccatcctgtcagcctgggagaccgcggaagcctttccccagaaagtggcctttaagctcagtttcaaatggtgagagttcatttcaaattgctgattggtgttctgctttttatctcttgtaatcccacaacctagctagtttcactgcctacaaaatcaccacaataatgcttattttgtgtatgttttttaatcatttgaaagtcacttagggctaccaaacataattgcttgatcctattttaatttacttgctgaaatggaatataataattaagctttgaatctaactaaggaagatattatatgccaaaattaatagttacgactcaggactgaatatctaactagaaagcattctcaggatagccatgtgtaggttaaaaatatactgtaagttggatggcaacagaccaaccggaaatcccttccccagcctgtgcttcagatacactgggagcaatcggggcattgtaagaatgaagggttggtggcgtcctccccacattagcctcactgttttccctgtctgtgctgatgatggggcactaatgattcttactcggaacattaacaccactccagactcaaagagcattacagctcacaactgaagtgctccccatcataaacccctctgctttcattcgtgctcggaaaagtcttgctctgagattagagttcgtgcactctggaaagggtatctccatactactgattctgcattcaaaatagaaaacctacttattttcagaacatgctttaaggcagtaataaaagcaccaatgataatttctgacctgataccaagccgttcataatttaaaattaaaaaggagaagaagaaagatggttatttctttctcttggtgatttcaaaatctcttctttttaaaaatgctctaaaagcattcagtgacttactaagaacaatatttcaggtggccacctccagatatgaaattctgattcctgtttctgtttaatggttatagacaatataaactcaagtgcttaaagagaagactgcctttgaatttaggattcaaatgttgcattgtattttagatttcagaaacgtaacatctctatataactaaatatcatttctcttggaaaaataaaagtatgatcctcttaatttgggaaattgtgaacaaaatacatttgaatatcactataatgctttttgcaggtgaccaagatgctgtaaaaattaaaataatttggagccttacccaggagtatttatctgcttatgtactcagaggtctccattacaaattagtctcttctgtaaagctggctctgaaggggggtaaatttgagaacattgggaaacctgaaaaatgccacaaagagcatggcatagggaaaagcaactagaaacgaaagaaaacgataacagaaggttcgccttgagcatctttcactggggaaatgggcctgaagtacagagttctgtttatacaaatcaataaagcttgaatttttaacagaaacatatgggagtattaattatacagacacccagcagagcatgcagatagataggtcatagaaaccagtgttgcctgagagcacgtgctcagtaacttgatgttcagagtaggcgccttcgtccctgggaaggagaaaagaatgatgatcataacaccgaagagaaaatggggaaggagggactttgactgcctgtgattggactgaagccccgtgctcacattttgatgcctgtaaagccttcatgaaatgaagtgggcacttactagatttcttgcctcccagattagactccctgaagactcaataactttgatctttgccttttttttcctttttctttttcttttttttgagacggagtctcactctgttgcccaggctggagtgcagtggcgcgatcttggctcactagaatctctgcctcctgggttcaagtgattctactgcctcggcctcctgaatagctgggattacagccacccaccaccatgcctggttaatttatttatttttagtagagacggggttttgccatgttggccaggcttgtctcaaactcctgacctctggtgatctgctcacctcagcctcccaaagtgctgggaatacaggcatgagccaccatgcctagcctctttgccttctttctatgcattttcatcttttgctaagattatgtatgaaaagacctctttggaaactcttgtcaaagtacaccatcagaaaacccctttaaaagacgatggatccttatcttttgtagggtgtataaatgccttcaaggaggggctctacccagaagatttcccaccctccctttgaactctctggctggtcaggatccatcagcttcttgtcaaatgactcagtggagagagcagtacagtttgggctccagattggaaagcatggccacccccaacactgccattcatagaggcctgtgcacagcctgcatcactgacaccatagtgctgcctccagttaggagagcagagattcctgggacccatggaagaaaaagaaatgactatccttcatcttttcttttttttgttcaacttggccgagcatctgatgtgggatctttgtaccatcacaggaaccaccgctgatgccttcatgtcagctcaagagctgtgtcctgacctgcctgttgttccagctttctgcttcctttaactggcatccattgcacagctcactgtgttctcctctccagctgctgccaccattttcttgaagctactcttaatgaaatcagcaacaattttttcttgttgcaaaagccaggaattccacccagtaagcccaatgaaagtagcagctcctgtgtgagccagccactgtggtaggcacaccattttaggccttgttagtcctcatggcatggggcattgctcctaccttctaagccctctcctctttggcttctgtgatactgtgttgtaggcatcttccaacttcaattccagttccttcattagctcttgtttctgccccaccccttgggatttcatcttcccctgaagtgtgtccttccctcttttcttgttcactccttaaaccaccttgtccactcccacctccttggccatccatgtatgtaggtggatttccagatctgattctcatttcctactggatatctccacctgcttatcaaactgagcatgtgcaaaagcatttccattatgcttacgcaaaaacactttcccctccagtattccttatctcagtggcttcttcatctgtggaatcctcccacccattcatcttccatagcagatcaatcaacagaacctctcagttcttcctcatcgacattgtggtgcctcctcctgttctccaatgcctctacttcaactcaggtgcttagggtctctctctcctttggatttgcacaataacttcctgactccctgcatccagcctctagctcttccagtccctccttcataaacaaccaccagaagaatctttctgcaacacaggtctgattgtgtcactctctagtgaaaagcttccaacggaccctaacttggcagagtaagtcacaaccttccaaacctactctaccactctcatctccaccagttacccaaacccaccacattctcatttctaggcctctgtgcatgtattagttctgttgctaaaacagcctcttttggcctctttgctacttggaaaatgcttattcatcaagagtcagctcaatcacccctaataggccgtcattgtcttttgaatgaatgaatgaagactggccccactctgtcaagcaaaataaggctgtttttattcactatcctggaggcatgttgttcatattgctcctgtcacatttgtcaacattgtaattgtagctgttcttcctatcagacctagcaggcatgttcatgtgtagcccctgggccgcctcgtcctcttcttctcccatggcagacatcatttccagccctcttttctactgagctcagacacagctcagaatctttctcaacacagtgctttcagcagactggtgtttgcacacagtttgaggtctgtctgccatccctgaactagactcgagcttttccagtgacaagcacagtgggttgcctaaagtaacaactcgattgctgaacaaataacgaatagattttcatctgaatattagctgtatattgctttgcattacagatagatctgtccaggagaatggattcatggcaaaagataagtgaggtgatttaccgaaatccactgtgacgctttgcagaaaatttttcacatatgcattcagttattccaactatcgcctgggctgccccagccctccctctttacagagttcagccaccgcgttgccttaaaatcaacacattgcacatgatttcttctagcctgcctttgatgtgtcttgcacatttttaagaagtggttggaagaagcattaaaacgagtttctaaccttatattttattttcataatctctctttttggcaatcacaaaggaacactgatgcatccagggaatttcaaaactggttaaaaagcaagagagctgctttttcacatcctgtatacaacaacagatattaaataacaatacttttagtaagccattgtttttgaaacaggcgtagtaactctcaaaaagatgttgtgccaaaacaatcaggaaaatgtgaaacaccccttttcacagctcaactaaaagatgcaattgaagtctcatcattgagttcaatgagtttcactcacactatccaattaaaagccttcctgaattctggctgcattccagaatttaaaactagaaaattgggaaatataaatgaataaatcaagaaagtttctattttttcctgattcccttaatagacataagacaactagttgttgaaagctcaaagtggaaggttcttgtgtgtcagtcctaagactgtgcggtgcagtaaacagaatgatgagaaacagagaaagaaaggggccggtgaaagcctgcagcatttctaaaataacagtggcactgcatctttgatgactctgaagcctgttcttttgtggcatcttttgttttttaatgaatttacactgttggtgaattattgaaatggtttcctctctctcaccttttatatgttttctctcctattatgttcccatctgtcttaactggaaaatccaccaggctaactgtcaggtaggttcttcttgatgtttagtgtgattattactagtatatatagagggcaatgaagtaaactgactgctggtgactggtgatgaatgataaagctaaacaggaaaggcacatactaaattatagagaaactttttgcagatgcataaaactgtacaagctgcaaactctaagcacattcagccagtgtgaacatctatcacaagaacttggcctaagggaatgtagcagctctaaatgataaagtaggttacctgggctgtccagcattttgctgtggctcaaaacccagactgctcctggagggcttcattgttctagagcatcattacatcccttgtggtcacaagtgattctgctgtaaatataatatcagcatttatggatttggtccagttcaagaacaatacatagtgatatcttttacatccctattttaagtatacatccaagcattatctgtgcctggaagaatgaaggtaactaggaaaagggggggtgcatatattttgttaatgtcaaatgcacccttggagttaagtccgatgtggtttaactcttgtgaaaggaacagtcacttgaaattgcagtaggagacagacctcttcattcaccctttagtgtcagggaaaagaagtactccttcatccacacaaagtagcggaacaaactctttttagatcctcaagggcaagacggataactttataagcccgaagtatagctaagcccaagagaggagaggcagacattaaaattagagtgtgcgtggtgtgtatctgatgtgtgtgtgtgtgtgtgtgtgtgtgtgttgttgttgtttttaatttgagctcatctttatctttcaggaggaaaaattgtgtgcttcagttgccacgcaacacaaactgctctaacagctttctaattttaatttcagaagtctacagagcaaatgaagaaggtccctactattattctttctgtctcatataaaggagtcaaatttattgatgcaacaaataaggtaagtaccactcctctctctggtttagacaccagatgcagtcctgagtgtatgatctaaaatcctttgcttcctataatacccagcactccccactgtaatcatccctttcccccaaccttcatgcttcctacatatacctatagatacacgctcatgtacacacacacatacacaccttcatacatacagaaaggaaccatttgggggaagggcttgatctggggtttctataaatattgtgctttcactttgtcatgatgctttctctaatagactgtggccacttattatccagcatgtccctttggatctggagaacattgaaacagaaaacaaaaatcacttgtagattgaaaagtcaacaatgtcatcactcctccatcagaggagatgttactagataaagggctagaacatttgtctttctgtttatctagagatatatatgtgtcttttctgttgataattttctgactttttaattttataactacatttaattcccagcctctgagatgggagagagtttcagctgtactgttttcttaagagacacaatcagaaaagagcccaggccatgctgtggctccgctgtgacttcttcctcacagtgggaatagtttgtgggctgtgatgtcaagcgtggtcagtggggttgcattttactgaaaaagcattcctttcttgacaaagacaacagcatcgtggtgctgaagtagaaagcttgggtgtgaccattgtccctctccataaactcaaagctgactgactcctcctcacaaaaccccaaacgttcatgtgttttattcctgcatcctttcaactaatcaagtacagaaggagggtaaaagaggtgatcaccattggtgaatgctggtctttctctggacctctcacccagacctcccacctggaccccctccgttttggagaaagggaacagaagtcatgaaacaggtgaacttaagaaacagcaacttagggccaaggcaactggatttaggttccagggaaaagtctcacgggcagtgactctttggtgtctctattaaaccccagcatctgaatcggaagtttttccaattggttttctgtgacgaaagagattgttgtttcagtagttaggtaaacccaagttccccaaatctgcttgggaaaacaacctcccggttatagaaaaagttctgaaacccaggcaaaaagcatataacccagcatcatgctgaccaataatatcagcataatggtgattccaactgtgcaaaatattgttgatggttgttgacagataataattgtggagactcaaataagaacaatgctgattgatttgcttttttatttcttggaagcatctttagttcctggtatataaaattactttatccttaaattatagtcagttggttttaaaagttctaacactttatggaacacattatagaatggcaaagataccattgctattgctgtatctaaatcttaagaaagactttggcacctggatttttttttccctaaattgaaacaactccctctatcccatttatgcttggaaagcttgaatagcagtatattttcagtggatgaatttgacactctcttagatgaacaactttagcagacttggattctgacaatttctaaacaagtggtatttgccctgagaagttcctacagtcctaaggcaatcatttcatgattttgggggtatggctggatgcagctgtattaatagcattttctctaacccactctccacaatcagaggaatgaaagagagctctgccggttccattgtatgttgcttactgacacggcaagagacacagaagttgatgctcctgtgcctcaaggagatacttctacttcaattgccaataattagatgagttaaccataaacctctgctcactgatgactactcttggaagcaaaagcacagaaagatatgcaaaagataattctatgtaaataaagatgctaaataaagaaggtcagcatattttttcaagtctttgcagtgtggtcctcaacatattttcagaatctagagcaaaggcaaagtgcctatgttggtggcaagtggagccagtctgtgaatgtatgacaacatgtgcctggctttttaaggaactgaaggatgttaatttcaactggctatacagggtccacatcccagtgacctgcaaggtagctgatctcccccagtatgacagtgggtagggagagtgtgggtgactcagggcaatagtctagtagttgctgtgtagggagcccaagtagagagattgtgtttagcaggttagaagaaagaaaatagtggaaggccgtattggtggagtttgactgggtaagactgagaaatactaccatcagccagggtgggaggactggcttcagaagggacggaggatccacagttgaaggatcatcctcaagttgtggtgtgaaaggaaccatgcccagatacctagattctagcagtgtgtgcgaggacacctgtgtatgctactttgttctagagcaaagagcacagcagaaaaggagcagattgataaactccagagtcctgctttctgttttcaccagggatttcccccactgggcagtgctgtgtcagtgggccactttgatttgaagcaaagaacttttaatatgcaagcatatttaaagatctcaccatttcaggtactagaggccactaggcctggaattcaagcgattctcatgcctcagcctcccgagtagctgggattacaggtgtgtgccaccatgcccggctaatttttgtatttttagtagagatgggatttcgccatgttggccaggctggtctcgaactcctgacctcaggtaatcatccgcctcagcctcccaaagtgctgggattacaggcatgagccaccacgcccagcctactgttcatattttatgttttcatcgtactttattcttcaacagtactctcctaaccttgcatctcgtacccctgccttggtcagagaggtgattgtttaatctgccctgggcagctggagacctgaaggcctcagtcccttggctcagtgctgccctgcagtcacacagcctgttggtcgtgaagaacgactaaaacttgattttcaacctccctaacctaatgctttttctgttactccacagctaccttccacaaattagtttgaagtgcaaactaattcattgtgtgataattcattgtgtgttaattactcttcccttcctattagcccccattagactttgtgaaagattaaccctccgtgaagcatttctttcctttgattataataaataaatgggtttggctgaattcatgggaaagggttagaggcctagttataaactcataaatgtattgcctagcaacttaggaaatgaattgaatcactaatcctgatttaagaaggaggaagcagaaagcgatcttgaattaaaagtggaacttgcaatagatttagcactaaagtgttttagataaatcacctcagccttctgttgatcaatagcccaaaggttgctctagcagggaattcggcctgggggactgcaactgtttagtaacggacccttcttcaggttgggggagtcggggagggaggtcttccgagaggagacacggtttctacattcagtgctcagctgaggagcaggttgcattttgccttcctgtgctgactccctcctcagccttcccatctggctaaattaaaaatgatgcagtgccagggtttgttttttgctttcattgttgttttgttttttgagtttttaaaaatttttttggaatgccaattttaaacaaggcctatgctattttaggggcacaaaatactttggaacatttgcctaaacaagtgcctgttgtttgggggtttttttgttttgttttgtttttaagagacagggtctcactctgttgcccaggctggagtgtagtggcgccaccacggctcactgtaacctcaaactcctgggctcaagtgatcccccaacctcagcctccagagcagctgagactacaggtatgcaccaccaagcctggctaattatttaagtttttttggagtgatgggatctcgctatattgcctaggctggtcttaaactccttgcttcaagcaatatttctgcctcagcttcccaaagcactggaattacagacatgagtcactgcagtgggcctcccattgtttttttttatagcaaatactcctaagaagcttggagacaaattaaggccatgttaagcacatgtgctgttctcagcatcacgtgccccacagggcatcaccagttagctctaggtctatactgttggccccgccctggagggaacactgcagtctcctcactcaggaaaagcccggctgatgaggagatgcaagagaaaggtcccacctgtcggggctcagattgaatgcagtggcgagaggcagatttctaagctgcatcacttcatcaccacgcgcccttctcagaaccaccatatgagttagctggacccgagaatcctgtcctacccctaccagcaagacacctcttcagctgtttctcaccatgatggcaaacaacagacaggcaaaaccatctctccctattgaagggtgctatgctgccagaatttctatccccaagaagaggcaggaggagcccctccccagttcttctcttgagccttttaaagctctggccttcttaaaatgtgcttagaaatggagactgatcaacatgtgaggagtccagttttcaactgaggtgcatcacctgtacctcttcatgacatcactttttaatttgtggaaaagccactcataaatgcatgacacaaggtggaaagaatgtgttcctctttggcttcttctccaaggaggaagtctaccatctagtctccatacagtctacaactgtagtatccttgacctttgattcgtcctgcacatagagaactggcttcaccattctgcacaggtagacaatgcagagtgatggcagtatttcagtagtgacatcccaggaccttaccccattctagcattggcaatatatcacaaaggtctgttcaaaaatacctgcctccgcaggctatcaatacaaattcaagagcatcttttaagcgccagttaggatgaccacaatgatgagttattcctacctgaatatagaatattttaactagcatgagctttccttatagcttagacaatgggaacagagtagtagaagtttccacagtcggggagaaggctgattttggaacatggagtatcacagaggtcaggcctccctgggcagctaaaagacagtcctgggctcctggggaatagagaacaggagggctgggccaggcacagtggctcacacctgtaatcccagcactctgggaggctgaagcaagtggattgcttgagcccaagagttggagaccaacctgggaaacatggcaaagccccttctctaccaaaaaaaaaaaatacagaaaataagccaggctggtggtgcatgcctgtagtcccagctactcaggaggctgaggtgggaggattgcttgagcctgagaagttgcagtgagctgagatggtgccactgcactccagcctgggcaacagagcaagaccctatctcaaaaaaaagagagagagagagaaagagaagaagagggctccagaaaattcaggggtcagcaaagacacaggaggagagagtaccaaagatatacttttcctcctttgcaactttcccccaggccacagtgctgccgtgcaccattggaaattgtcaagagtggcatcccatgagttggcaagattcagagagttcagtgcaataaaaatcacagagcacttttcatttcccaagaagtgcatctaccttgagatcttgcaaaagatctcaagaacacaaaatgccaacttagtaaaagttgaagcacctatttcctgtgacagtgcctcctggacaagtgagaccaaatccacccaggcttcccagggcattggctgcccccaatcaagataatggcagaggttcccacaccatctcacattgcacctttttctcattttaacattattttaagactcacccatccctaatttggttttctacttgaaggaatgctatctggatgccagaagaggatcatcaccttctagtctgaaacttatcttgcaatagaatgttacttgtttatgggattccaattgcaatttgagttattttttgacagagcactgcattaatgtcaacacaaaaggccacggtgaaaaatgtcttaatttaattttcttttgtgagttaattctgtaattgcctccgaaccactcagcttggtaaagtgagggacatgaagtacttgctgggggtgctggcagggaaggacattttgtaagcatttttaggcattgatggctgtacacggaacactgtattgccaacaggttatttaagacagcgcaattaaaaagtaattagagtaactaaagcatcgagggttttagatctgtgacaactgcaaaaaaacataaatgggatattataagataagaaaatgattgcaagattatgtgaatttttttctttttttctttttaaacacatctatgtatcaaaagaagtttctagcagggtttgcagccaagctgcttcgtggttattttgtgcttcaggacaatggtacttaaacctttctcccaccagggaagaaggcacaaagagatgctagagaagaaataactcaattcttgttaagccagtaagagggaggtggagacgttgaagggcattgcaatgcatttcaaagagcctgagctccacagtcagacaaccccaaatttcagttccaccccagcacctgctctgcataaggcacttaaattctttgagtaccagttgcttcacctgtaaataatggtagcaacagcaccacctcctaattatacacagtggatgtagttaggaaagtgttgttaatatagccacagggcccagatcaagcaaggcatccaaggcctgaatcttgcagtatggtgtttctcttatcaggcccctgcaccttagtttccacggagaaagcaccttgaggcttccacctgcctgcttccttcagtacctgcccttgctctgagggaggaggagcaggacacaagaacaacgtgcaagcatgatggcgagggatttgaagagcctcattgggtcagatctcttctcatacagagaaagcgacagatgctcccctccatacagaattagcagaaagcagtgctgcacagctacaggtggacatggggaatggaaacagtcaaatgcttagtaattactattattttttaaagtggaggccggacgcggtgactcacgcctgtaatcccagcactttgggaggccgaggtgggcagatcacctgaggtcaggagttcaagaccagcctggccaacatggtgtaaaccccgtctctactaaaaatacaaaaattagccaggcctggtggcatgcacctgtagtcccagctattcgggaggctgaggcaggagaattgcttgaacctgggagcgggaggctgcagtgagccgagattgcaccactgcacttcagcctgagcaacagagtgagactcttgtctcaaacaaacaaaaaaaaagtggccgccacccagactgcttctatgcacagcaactggtgagaactgcagctccaggatatgactgtgttaggttgtttttaattaaatgaaaatatttcttccatatctggtattcatttacccacaaataatatagtggaccactttgagtgttgctagtctagaacactccagaaagaaggaaagcaactgcttcctgggttacttgtcttggttgtcatatatgctggttcgcagaggaaaacaatgatcatttatgtcatttcttccagaacataattgctgagcatgaaattcgtaatatctcctgtgctgcccaggacccagaagacctctcaacatttgcctatatcacaaaagatttgaagtctaatcaccactactgtcatgtgtttactgcctttgatgtggtgagtacccaccccctttcaacagattaaagactttgcagaatgggcctggactgtattgaaagcccaacttataattaacacactagcttggcttgtttacccggtattaagatacataccaagtgtatttgtttgctagggctgccataacaaagtaccacagaccgagaggcttaaatggcagaaattcattttctcacagcttctgggggccagaagtgtaagaccaatgtgtcggcaggtttggtttcttctgaggcctctctccctgccttgtagatggcggctgatatggtttggctgtgtccctacccaaatctcaccttgaattgtagctcccataattcccatgtgtcatgggaggaacccagtgggaggtaattgaatcgtgggggtgggtctttcctgtgctattctcatgatagtgagtaagtgtcgcaagatctgatggttttataaatgggagttcccctgcacaagctctctcttgcctgccgccatgtaagacatggctttgctcttcattcaccttttgctatgattgtgaggcctccccagccatgtggaactgtgagccaattaaacccctttcctttataaattacctagtcttgggtacgtctttattagcagcgtgagaactgactaatacagctgcgtacttgctgtgtcctcacatcgcctttcctctgtgcttagatgtctgggtccaaatttcctcttcttgtaaggacaccagtcagattgcatcagggcccaccccaatgacctcattttaactgaatcaccactttcagggcactatcttcaaatacagccacattttaaggtactgcatgttaagccttcaacatatgaattttgggtgggtcacagttccactcataacaccaagtacattttggcagactaggctgtttggagatttttcgatattttcattcttccattcaacttagaatgccagccctacctagtatctcaactgccattactcatttactaatttcactttcagacttgagaaatccctttgtttctctggcaccaaaacatagtaaaggtcttacagcctccttgtccctcactatgtctgtcagtttctctagtagccatttctaagtactagggcataataggtgtgtttgcctcatacaaatctgcagtcttctatattgaataggagtcagatcagatacctacaggtggtaattgggaactccaagatttggcccatatgctcattcagaaattagtcttggctgggctcagtggctcacacctgaaatcccagcacttttggaggccgaggtgggcagatcacttgagctcaggagttgaagatgagcctgagaaacatgatgaaaccccatctctacaaaaacaaacaaacaaaaattagctgggtgtgatagcacatgcctgtagtcccagctacctgagagggtgaggtgggaggattacctgagcctgggaggtcgaggctgcagtaagctgtgatcacaccactgccatctagcccaggtgacagagtgagaccctgtctcaatttttaaaaaaagttactcttggccaggcacagctcatacctataatcccagtactttgggatgccaagttgagaggaccacttgagttcaggagttcaagaccagcctgtgcaacatagtgagactttgtccctattaaaaaaaaaaaaaaaaattagccagacatggtggtgtacacctgtagtcccagttgctcaggaggctgatgagagaatcccttgagcccaggacactgaggcttcactgagctatgatcgtgccactgcattccagcctggactacagagtgaaaccgtcactcaaaaaaaaagttggtcttgtaatgacatccttatgggattacaccacttccatttatagccatacttgtcattaaacctaaaagactagctcatatattacaaacttggaaaatggaaacaattaaaggaaataacaaatgtttctttaagattgatatgccctcaaggtggtacaaattgcttgaggatatctctgatatagtatattaataatttataatcagaagaatttgaaaatgccacttaagtttgatgattctgctctgctcactgggtttgaaatatacatatttaaagaatcaggaatcacgtattcatatattcgtgagaggccagcccccagttcaatgtcatgggtagaagactgcctgaagcaatgttttccagttctgatgaacacctataggccaaggccaactgtaatccaaaatctataccagcttaaggtccgtgagtcaggcagttcatgctcagagcatttgtatcatgctacatgttcctcaccccttttggtttttaaagaaagattgaaaatgggaaagaatgatcatgggcctttaaaaaaaaaaacaaacccttccatttggggaggcttgaggagagtgatataaaagtagtctgtggtaacagtaaagactgcaaagcaaagccctgcgagactgctctaaatatctcaggaagcgtttgtttgcacgggattaaagtgttgattaaagccatttcattcagggtttacaaggatgtgcagtgttaggtttctggtgccttaaacataacttgcaattcttgtaaaatttgattgtttctttatacagtcaaatttcatcctgttcacatctattttggtttatgtgaaatacctttctctataggggttggattgatgtcatagaaagaacggaataccaaagttcacatcccaaatcagctatctctctactctctggtcttagagaagttgctggacttttcccagtcctaattttcatagctagagaacagagacaagagtttctaccttgcaggttttcaccaggagtgaaatgaaagaacatatgtagagtgcttcataaataacaggtgttcagcatttgttccttcacctcctccctctccctgcctgctgacgtcagttaacagcctgaccctttttctgctaaaagacataagataggtttgtcagatgtgtatttatcttccaaagttttcctactgccattacgaaaggattgaaaaagtgaaagcaataaataaacattaaaatagaaatagcagaaagaaaacattgactccacagagcttgctgcctctagaccgtgtttgcattgaacatcaacatgaatattctgatacttttcaggatgaacgccacctttttcctaagtattgcagcatttctttcaataaaattggtttttaaggtaatatataatttgccttcatcagagtatctaaagtatttttccacatgaaactaaaactggtttctgtggactatctgcccccttgagtttattagctatacgtgtgtgtgatatatatatatcaccagaatactgaggtgaaatgttgggggaagaaatagtcaactgtttagttttatgatgaacgttatatccctgatacacttagaaaaacatgtagagaattgccttaacatttatcttttcatccagatgtttgatttaatgtaaacattactagcttaggattctcataccagctccaaaggactttcatcttacacagatcctccattttaatcttctccaggtgaacagtttgtcaaacctcaaaattagtaacaaaggccaccacccttgacctgggactttgagcaattctgagatgcaacaagcttcacttgcactaaaaaaagcttctttgagcatggattttgtatccttatgtagggcagttcaataccagtccagtcttgaaggcttaaaattcttttgatatgaatcagtcccctgggctgccccaaatggcaaaaaaaaaaaaaaaaaaaaaaaaaaaaagtaaagaagaccctataatacctcaaatacacatttaaccttttagctaaataagtatgtatacatttttaattgtgaagttactgctttttggaccttaaagaccttttatgggtcacatgtttttatgtactgttatcacatatcccatgtttttatctgatatcatcaagaaaattcagtgatgtctaggaagtttccagtttatggacagttagatttgaagttcagagcattttctcatagaaattgtagtccgagaaaggaggcctggagccccccctacagaagctaggatgtgagcttaacatagtttacgtactatgggactctgcagggccctgaatgtgctcagatgtgaggcgggggtggagtgtgcggggcttcttaagcttatttggccatggtagccatttttttttttttttttttgagatggagtctcgctctgtcgcccaagctggagtgcagtggcacgatctctgctcactgcaagctccgcctcccgggttcacgccattctcctgcctcagcctcctgagcagctgggactacaggcacccgccagcacgcccggctaattttttgtatttttagtagagaccgggtttcaccatgttagccaagatggtcccgatctcccgaccttgtgatccgcccgcctcggcctcccaaagtgctgggattacaggcatgagccaccgtgcccggccttttttttttttttttttttttttttagagagcaccccacaggggtggccttctgcagaacacattttggaaaatgttacatttgatgatctctaagcctgcttttgttgcttggaatctaccataaattcagcttgtgatattttcagttttaaatgatggggagatgaaaataaaaagactagagcaaaacagaattagggttgtcaagaaaaaagccaatatatacacacaagcaagcaccaagcctgctctgtattctggagtctatgctctcgttgttgtcatagctgatttctaatcatatccctaacttgctaggcctgaaacacatctcacccactgtagaacaaaagcttccccaaactccaccttctgggcagtgagaacttggggaagagggaactgtagggtgagcagaaaagaaggatgtgttatgagactaggagttgtgagagttaaaaatggactcagcttttctctcctctgctcttaaatgagtggagagaattctacacaaatgggactgccagagagggaatgggtatttcagtggccaccagatcccgaggctgaagtgatcgtcctcaaaaggccactataggtgagagagagagacaaccaaggtaatttcaaaactgttgtcttctgtattttatttgcttagttactctagatttctcagtaatagagagttgatgtaagtcaacatagaaagattttgatgcattctccatgggagtatcagatttgtatcaaatatctgagaagagcctcattcaatagttttaaatgttaaaaggtgttcttcctttttaatagcattaaaagccatggctttgctgccagacccttgctaattctcactcctctgaaaagaatatgtttgcagtctttgatatttttaaccatgctcatttttcacttgcaactcccaaatcctgtgctcctcggtgtgcagcacatggcgaggctgagacggtctcaggagtgcgtagagaatgttgaagacgtggtgcagggtgggtgggacgtgtgggagacggagctccctcttccctgtgctttcttggctgaatgtgggccatgtgaggatctaagctggagaaacagaagtgacaaaacgcaggaaaacatggtcatccgactgtgtgatcaccttctgtagtactctcccatccatatgcacaaagccagccaaagtgtggggcaagaaaaacactagcatcaaccacgtggtcgtgatcagtgatacctacaccacttccaactttggctctgctatgagtttgcttgttggttttctcatcagtttaataaaatttaaattcctggctgggcacagtagctcatgcctgtaatccccagcactttgggaggctgaggcaggaggatcacttgactccaggagttcaagaccagcctgggcaacatagggcaaccccatgtctgcaaaaaaaaaaaaaaaaattaataaataatagccaggcatggtggcacacacatgtagtgccagctactcgggaggctgaggtgggaggatctcttgggcctaggagacactgagctgtgattgcaccactgcactccagcctaggcaacagaacaagactctgtctcaaaaaaaaaggaaagaaaaatttaaattcttgagtgcttttttaaatgccgagattacttccatggagtagtttgaggtccctgaagaaaaatatttatggcttatgttgcagagattgtcccacaaagtgagaacttaaagatgcaaaagaactcttgctattattgatgttagttcacctctgacaattgaattaatatcatggaggcgggtgatctctctcattctgtttctcattttctccacctgaaaatagacttcaacctatttgactgtgatactgtgaaaagaaatggcaatataagaaaatgtcacaatgcatagagcccttaaaaattgaactcgaacactttccctggttactcttctgcatacaaagtggcaacctacaggtaaaagagaagccgttccctggccctgtccagccagctgaaactcaccagcaagtcagctgcaggaaggacgcagctcctaagaggagcaaatggccctgatggaataaaaaagacagcatcgcattccaatggtccttctacactaacaccaccacctcccaaaaaagaatagataaattaacagtgctgggtttcatttatccagatctcctctccattggcataaatcactgagaactaaccaggccacaaagacaaaggtggttggatattcagagatcttctcatccctattttgggggtggggagacaaagttttcagtgccttaaattaatcccattttttgtgaagttagaaaccagacattctgaaattgttttcacagattgctttgcagcatttatgcatgtatttgttgcaccccccacttctaaataactggcagtcaagtgtcatgatcagggggtggcctttagaatcagtctggttttgaatcccagatctgcactcttagcttcatagtttgggcgagaatgccatgggccaggcacgatggctcatgcctgtaatcccagcatttgggaaaccaaggcaggcggatcacctaaggtcaagagtcccagactagcctggccaacatggtaaaaccctgtctctactaaagatacaaaaattagcctggcatggtggtgcacacctgtaatcccagctacttgggaggctgaggcaggagaactgcttgaacctaaggctgagacaggagaatcactcgaacctgggaggcggaggttacagtgagtacagtgagcagagatcgcaccactgcactctagcctgggtgacaggatgagactctgtctcagaaaaataaaggccaggtgcagtggcttacacctgtaatctcagcactttgggatgctgaggcaggtggatctcctgagctcaggagttcaagactggccagaccagcatggtgaaaccccatctctactaaaaatacaaaaattagccaggcgtggtggtacacacctgtaatcccagctacttgggaggctgaggcatgagaatcacttgaaccaggaggcagaggttgcagtgagccaagatggtgccactgcactccagcctgggtgactgagcaagactctgactcaaaaaataaaaaagaatgcctctagtcttcagtttcctaatctgtaaaatagagattataataggacacctcctatggtgattgcaaggattaaacaaggtgacacatacgcatttccagcacatggtattcaataactcttagctgccgaggacacagagaatagcagaagcagttaatagtgatgcttatattcttgtcagaccctgtgtgaggctttatgtcccggtttttgattcacgacatatgtttgttgctgcgtgcttccacatctgaggaaaaaagtcagattccacataaaatgcattcctgtattgatagagtgcctgccatgcattagacacacatccctgctctccaggagctcatggtccagcaggagatgaagggacacaagcaaatagttacaacagaatcagatccatgccacccgggcactgcaccagcagccagcagggtgggctctccaagaggagggacgcgcaggttggaagctgaacacttagtctgtgtgagtgaacacgtggtcggtttggaggcacggcaactcattaattcaatttagaatagtgaactcagggtatcaggtaggcatctgcaataagtaaaggaaaagccatttatatttgctgtgctgactaaaccaaggaaacaggcatatccatttgagaaagatttaaacaacaagggttcaaatttaaaaggtttgaatctggtgagtgacccatgtccaatgcctcacaagttagtgaagaagccaggcgcggtggctcacgcctgtaatcccagcactttaggaggctgaggcgggcggatcacttgaggttgggagtttgtgaccagcctggccaacatggtgaaaccctatctctactaaaaatgcaaaaaattagccaggcacggtggcaggcacctgtaatcccagctactcaggagactgaggctggagaattgcttgaacccaggaggcgaaggttgcagtgagctgagatcgtgccactgcactccagcctgggtaacacagtgagaccctgtcttgaaaaaaacaaaaagttagtgaagagttccctacagcttccactggagctttttcttttgaggagcaggggagaggttgaaatctggcatttcttcctcctgtaccacctttgcacaaaccctggccaagttacaggataaagattgcatgtttcttcctcccaggcaggccagtccctctggatgggtgtgacagggctgctggccagccaccttaggctgtggttccatgaagacaggtgaccagtgtgttgggctgcagtgcatgacatccacagggaacctggaatgctattaatataagaaagcaagttgtggtttaacaaagtaaggcccaacctcctatacttggggtgaggcataaagttaaacctcagcagatacagtggaacgctcaccccctttaaaaatctggtttttgaagaacgtgtaatggcatgcgaagaccaactatgagataatgttgcgcaaaaaaggaacttatgagactgcacataaaatatgttatgattttagactcataaagtattctagtttttaaattcatatttaaatattcatataggaaatgaaagtatttgggtgtatatacaaatataaaaagaaaatgcaccaagatgttagcagtagccatatcccaacagtggaatttcacagctgaattttattttttcctttattcttagtattttcaaaattttctacatctgcccctgttataattagggagataaaggaatctcgtggctcttttagttagccaaaattagccctaaagaagctacctgcattttggccagttgatttgtcatcttgccccagatagacatcttagcagaattgctaatatttgtttctaaatgctgaaggctatgattgggcactatttatttctgtacaatctatgaagactaatttctggctggtacttgagagaactaactataggtagagctaaagagatgtcaatgaagtctgtgaatatgcccagaatattctcgaagttatttttgcctccggacgtgggtgaagcaagttgtagaccaggcttaccccaggtcttaaaaaaacaagtacaagcaaaatatagcctaaaaagaaatgtcgcttctttctggagaccccactgagaacccagattgaaaaaaaccttcttgtgtcttcaggccccctgtggcattatctgcacttgtctagcttttgttcttcaggtctgcctgtgggagagaagacagaaggaaggaattggctctggccatccatattcccccttttcttaaccttaaggtgcaagttcccttatcttagggacctaccaggcaacttcctttttgtgtttagccaacaaacatttcttgagcacctgacctattctaagccctagagatgcaaagcccagtgagaccagagccctcaaggagctcagtcaactgggggaatcagccctataaggagaaaatcataataaataccacgtggtaagtagggctgtgcccaaggtattgtggcaccgcagaggaggggcacctaacttagccagggttgggaggacaggaaaggagattcaaagaaggcttctggagatatgatgcccgaggtgagtcttcaaggataagcagtaactcaccaggcaaaggtgggagatggcaaacgcatgtattgccaagaacaaatccattttgtaatagatgaaatgcttggccatttggaatagcatttaggggtgattgctggaatgaaggtgttttctgagatgaagggcagcccgttggtggtgactgcctctctgagctctagctggtgggttatggagccctgcagtctggcctctgggtaacatgccactgtttagcacagcatcaactgtgcgtgcatctctaaactgaatctgtagttgactgggtaaaagatagccccttctaatcagagaatcctgaaactcccagggtggaaagggaccaataggtcacctggaccacacccacttctcagtggcaataggtgctgtaggtaggtagcccatggtggagctggcctatgcaggtgatccagggactctgtttatggcctctattcactgatagacacttttcaatcagacatctcaaggtactttatgacacccaagcttttctgccctggactcccacatacagacacagcccttcccttgaacgtgtctgcatctgtgccctcttcatggtgtgggtgagcttctgctgacccctgtctgggcctgcagctctctgatgctatggaatgaatacatttgttcattccattccagtcatgaaaatgtggccattgtgtttctaatggtaatgcaaagcactgcaaggcaggtcaaaatggtccactcagaaagagcagcctcccagcctgggtcaggagggcctttcctccctggatggcctcctcctcagattccttactccttcgtcatattcgccagatgagatgaagctttatgcctgacataccttgtcagccatttgggcagcaatgcattcaacaaagtaagtcctggaataaatatctaagtgaacaaatggacagtgtttctaccatgcctcattccataacggattgaagacagcctacatgaataggtatagtagtctgaaaatatatatatacatacacacaaatctgaattagggaaaatataggctaaaaggaagctccatatcaagggaaaagttgtagcatcaatatacagaccatggagttgtggaaaggtatgggagctgggctctctctagctctgagcttttagctctgagcttcctggaggtcaaggcaaaaagggaaatgcagtaattttatgctgcatatttctttgaaagaaaagtataccccttcccttccgaaaatagtattttaataagacttaagtatgaaggaactttctgtcctaggcccccatgaggggatactgtgtaataatgtcttcaccaacatttgtacagtgaatctccaaaacacaagatggtgttctagagggtgcctcaatgaaataggcacagaagaccagcacattcatgagagcaatgaaggtaggatagcccagtggcatgaaacactggctaatctgaagtcagatctgcacttgaatcctggctctgctgtatgaacttggccaagttgtcaatttcgctgatccttagtttctcacacgtaaaatgaggatggtcattcctcctctgtaaggtgttgtaaggggtagacaatccacagaaggcacttagcctcgtccctaggatgtagtaggcaatatcatgtgtagttgctgctgccactgctttatcatcattatgaaaggaaataaaatacagttcaagttcataggcagtttgacttcgtgcagagatcaaactttgcacagctacaagagcggattgactgcatgtctataagttaatatccacgtaacaacatttttcacttgggcttggcagaagttggaccattaaagggtcaattccgcacttggagtagaagtattagggttgcagcttaaaggaagagcttgatacttcaaagtctcactgagaagatgttagaattggcatccagtatgaaaactgaagagcctaaacaagattctttgccaaatgaatgggcagcttcctggcacatagaggtgagccatgacagcacctgcagagaggttccagattttgctggaaagtagttcccagccctctcagccagagaatgaagagaccctcagaaccccaaggtgatgcagaaagaataagatccatcctgggcaacatgttgaaaccctgtctctaaaaaacatacaaaaatcagccaggtgtgatgacacattacctgtggtcccagctactccagaggctgaggtgagaggatcatgtgagcctgggaggtcaagctttctgtgagccatgactgtgccactgcactccagcctggacaacagagcaagaccctgtctcaaaaaaaaaaagcaagaataagactattttaaacgcaaaagactttctcttgtttttaattatcaaaatggaaagattattttatgactgtaaacatcattaatcctcatttaaataaagttccaaaatacaaaaatagaaatcatccagtctcaatacgcagtgataactactattcacatttgatccatattgctattttctatgcatatatacagatcctatctatgtgtatatgtatacatatatttttacgtagtcttttaacccattattgatttatttattttatttatttatttttagacggagtctcactctgtcacccaggctggaatgcagtggtgcgacctcggctcattgcaatcttcacctcctgggctcaagcgagtctcctgcctcagccccccgagtagctgggattacagatgtgcaccaccacgcccagctaattttttgtattttagtagagacagcgtttcaccatgttgcccggggtggtcttgaactcctgagctcaggcaatccacccgcctccagttttcatgttaaatggctacctagtattctacttaatcagtcctctaataatgaaaaatttaaacactttaatgaatatttttgcacatgtatcagtgaacccttgtgcctaagagattttcaaactaagaaacaaaaatcttagtgatgtaccagttaaaataaattaattaccttggtggctagagctttttctaggggacagattgcccaccatctatgatgcaatttttctcatactagaccgatgaatatgctgcgtatagcctcggggacaaggatgcgggaggacagcgaggaagatctctttgtctctccatgagcctcctctggatgtaatgagagtcttgatggacacttttactcccccatgtcattcagtgatcacttcctggacattgtctataggctaggcatgggactggcaccagggacacagcccttaacacttggaaggagcttggtaaatatctgtggtgatgttcaatatccatgattgccttgaagaaaccacagtaaatataagctgacctgcatatcttcagcttgcacaagaaaagtgagtttgcatcccttgattgccttaggatttatctttatgatacagtggttccttaagctcctctaatgtagcagttcttaattcgcagatcaaaatcccaggccgggcacagtggttcatgcctataattctagcactttgggaggcccaggcaggaggatcacttgaggccaggagctcgagaccagcctggccaacacagtgaaaccccatctctgccataaaaaaaaaaaaaaaaattagccaggcgtgcacgcctataatcccagccactcaggaggctgaggcaggagaatcacttgaacccgggaggtggagatggcagtaagctgagatcacaccactgcactccagcctaggtaagagagtgagaccctatctcaaaaaaaaaaaaaaaaaaggaaggaaaagaaaagaaaagaaaaaagaaaaatccctggggaagaagagaagagaagggaagggaagaggggaattcctgtgctttccaggaggtttttccccattggactgggactccctacccttcttcctaaatagccactactgaggatgggagttgcctcgtatcttttacctcacccttggggaagccaaagatgaagaattcctgtgttgatggtctctgtggagtcacgaagtacacccccggcctggaggctgcctctcagccagactgggcatgagacccaggcaatgggccagtaggtgacctcaccacagccaagatgggtcagtcacttggaagctcaattggctcacatgttttttaaactttttaaaacagattacagaattttttttattttatcttatgtatagttttaaggtgtaatggtcaagaagagtatagcctctcagaaagaacaactggattcaaatcccagtttgtctgggtgctgacttcatgagcaagttatttaacctttctgagcgtaattatctcatgtgcaaaatggaagtaatagacctacggcatacagatacggttaggattgaattaaagagcccatgttgaagcacttagcatggtgcatggccacatagtaaataataaatgctagccggtattgccatttggttaaataatattattagccattatcagaacaatccagttagggggtactgcgtatggtattatccccattttaagatgagaaaaccaaggctcagagtatgctgttttcagtaatcaaccctcacacctgcaccccgtgtgcacacacacacacacacacacgtgcacacatgcacacacatgcagctctctttcactggtggtctctgtaaggtagacaatactccagaccaatcgccgtaataaatgtgtctcaaaagacttatgctagaaagaccaaagcaagtatcttccaatgagcttatatgagacaggaagagccaaggtcggagacaggccaggttacagcattcgagagacgtgaggtaataaaagtaaaactaaatgagtttgaatttatgcccaagggaggtagtaactggagatgagagcatgattttgctgacttcactgcagcacagtggtttgagccagcagatgggatgggacaccttagtgctcactgtgatcagtgagcttccccacagccagggcagccaggggaccgggtggctccaggattggcctcctggctaagcagcattcatcacagctcctgggctcatgggtcatcttcctgttgtctgaatgagggtccaaccagccttctgcagcatcgcatggtgttccagttatctcttgctgcgtaataaaccaccccaaaatataaaacaacatccatttattatgttcacaattctgtaagtcagggatctgggctgggcgtggcagtcctgctcaacaacatctggggcctcagccagagtgcctgcaatggctggagatgctggggcagcccgactggagccatctgtctgggtcttgagtcttctccaagcgatgtctgctggagctccaatgtctttgagaccccttcactcccaaatcttgagcctgggctggcctggctgaaaccgttgttcctgtccaggcagcctctccttgtggctagctcaggcattctcatagcatgatgatctcaggatagcaagaacttttttttttttccttttttttttaagattgagtctcagctgggtgcggtggctcatgcctgtaatcccagcactttgggaggccgaggcggatggatcacctgaggacaggagttcaagaccagcctggccaacatggtgaaatcttgtctttactaaaaatacaaaaaagtagccaggcgtggtggtgggcgcctgtaatcccagccactcgggaggctgaggcaggagaatcccttgaagccaggaggcacaggttgcagtgagccaagatcgcgccattgtactccagcctgggcaacaagggcaagactccatctcaaaaaaaaaaaaaaaaagatagatggagtctcgctctgtcacccaggctggagtgcagtcacacaacctcggttcactgcaacctctgcctcccaggttcaagcaattctcctgcctcagcctcccaagtagctgggattacaggtgcctgccacaaagcctggctaattttttttttttttttttttgtatttttagtagggatggggtttcactaatggccagactggtcttgaactcctgacctcaagtgatccacccacctcagcctctatattagtctgttctaatactgctaataaagacatacccgagactgggtaatttataaaggaaagaggtttaatggactcacagttccacatggctggggaggcctatggcagaagacaaagaagaagcaaaggcacatcttatgtggcagtaggcaagagagcatgtacaggggaactcccatttataaaactatcagatcttgtgagacttattcactatcacaagaacagcatgggaaagacccacccccatgattcaattacctcccaccaggtccctctcacaacacgtgggaattatgggagctagaattcaagatgagatttgggtggggacacagctaaacaatatcagcctcccaaagtgctggaattacaggcgtgagtcaccgcatccagccaggatggtgagactttttacatgactaattcccccagagtaatgttcctagaggcccaggaggaaactgcaagactcctcatgattcaacctcacaaattcagcatgttgcttctgctatatcctatgggtcaagcaagtcagtaaaaccagtccagattcaaagagcagattcgacttctcaacaggggaacaccatggtgtgcacgggaggggagagttgatggcagtcatcttagagacaagctgggtagacacatgggttgggccaagagtgggggattttgagcacagatattgggtcatgtcaagttctgtaactttctgtctctgtgatgtctggaaagttatttcacccctctgagcctccactgcctcatctataaaatgaggataatatgctactgcatgtgatttggtaagacttaaatgaaacaaagataatgcttggcacatctctcacacctattaagttctcccttaatggtagctagactgagtattaactagaaatgttacgattactccagttagtcctgtggatattcattcattcattcagcaagcaagcaagcatttcttctgcacctggaatgtgccagacccagtaccaggcgttggcctccccacagttgcagggataatatgttgaaggcagagacagttgggctttcagattttctgggtgtcaccatgggctcttcagagccagccagcatcattgaggtttgcaagatgggcttctcacctaagccttctgatgttacaatataattttcaacctcatcccggtagagtctcctcgtacatgatagcaactctcctcccgtttcagatggtagggatgttaataggagaggcaggagaattgaacctacaaaaaaatgggggttctttccccattcacacatgtgtcctgaggtcccatgggatgagcatctgtttccccgaaagggccctggtgtgtcgggatgggcaacacagcacttggaaggtgtgtctcggtgcccatgggccctcctggcatccagcatcagtaccacaaacaggagggctgcagacaagagaggaaaggtaacagtgtccaatcctgtactatacataatcacaaaagaaacttgacaaagcattctaaaataaaaccaaagcaagaagtcaaggaaaatgtaagcggaaccagaagaagccattaggcaggaaaacttaatccaacagtctggtctgtgtgtcttatttgagcagtttcctaataccaggaactaattaaaaatgaaagggcaggacttctaacacattctctcccaaaacctttaggcttcccataatcatgtgaaaaacctcacttgctcaaatgaaggtctttttactttcctttgaagatcctggagctttaagtagatctcgctttcagtaacttgtttttaggttaatggtaaaggaattcacactcattaagttccactgttacagcagataaagaccacatgttacagaatcactgaatctcacaccttcatcttagtctagtttcccacccagaacaggaatatctggtacatgtccccaacagatgggaatcagccatcttccacagtagcatgaacaagaccaagagcctgtgtcttcattgtgagactacagaagtcggaagccctgcctgcctttcagaggggacccacgcaaacactaagaggcaaagctgacagtgacgtgagtgccaagtgtaggcagtggaaagagctcagccctctttgtgcagtgatggtcagagctgtctcccagacctcctccactatcatttgctggtgcgttactaatttactaggctgactcatctctggaggcaaacatgggctcagtgttcgttgcaaggaagtgctcagcttgctgtgcaaggtgcagtatctccagcaggcagatgtctgtcttgtagggtcagtatttcctagcaactcacttaaaggagacagacacatcctctctcaaaccgactctcaagctcagaggcattttccccacttggttctgagaccatcacaattgatctggcatggatctggaatctggttggtctagaacccttgggcctctttcccatggcctcagaaggcaccatcctgcatcttcctctccatcatcttcaaatgcgaacaatcgcaaacacatctccccagcagcagtgtgggaatcgggctcccagagcgcttgatgagggtggagatgggcaggaacagagagggccagcttagttgcaatatcagcatcagcagaatgacatttctgtgatttttgagaaaccgtgagtggacattctagggacattcatcagaatgaaaacttggatggtcaggcacggtggcttacacctataatcccagcactttggaggccgaggtgggtggatcccctgatgtggggagttcaagctcagcctgaccaacatggagaaaccccatctctactaaaaatacaaaattagctgggcatggtggtgcatgcctgtaatctcagctacttgggaggctgaggcaggagaattacttgaacccaagaggtggaggtggcagtgagccgagattgtgccattgcactccagcctgggcaaaaagagcaaaactctgtctcaaaaaaaaaagaaaaaagaaagcttggggcagaccatgcctgctctcagctgctacagtgaccttcagaacactctctgtgaccagtatgcatctgcttctctgatgctctgtgacctcagggtgtggtggccaccctgcctcttttgggtcagacaatgtgatggtttctcagtgagagaagacaaggggaagctgtgcttggaagaaaaggcagaaatcaaagatacacatttggagaagagaagaaagctagaaatcatcttgagaaaaggactgattgaaggtcggaagaaaagaacttttctcccaggcgctgcttggcgtggcatctagcctgacagaatcacctgtctcttgctgatttcatgataaaatatagagtggacccacagggagagcaaaagcctcaagaaatagctggggaattggctctgttggagcactgtttgcgtgctcactgctgcgactgtgagccgccacaccagcatgactaatgcctctcctctaggcctaaattagattttgattgtgtttcgtagatgttcactgaatcacagatgtttgaggtaaaaagacccaaacttctcaggaacacctcctgtggagtgtgtgggatcatcctcacaggcaaggttgaagtgctcccaggactcagcagaaataccagtagtaaccccttaccttccaaggccttggggacaaaccaactgcccacagggagagctttgaatggtgtgggctcctggggccactgggctgtggggcctgctcctcctggggctaactggggatctgtaagcaagagtgccctatcagtgtgtaaaccaaaaatatctgagacaagtctcagtcaatttattttgccaagcttaaagatgcacccgtggaccaggcgtggtggctcactcctgcaatcccagcactttgggaggctgaggcgggtggatcatgaggtcaggaatatgagaccagcctggccaacatagtgaaaccccgtctctactaaaaatacaaaaatcagctgggcgtggtggcacgtgcctgtagtcccagctactcgggaggctgaggcaagagaatcgcttgaacccgggaggtggaggttgcagtgagccaagattgtgccactgcactccagcctgggtgacaagagtgagactccatctaaaaaaaaaaaagaaaaaaaatgcacccgtgacacagccttgggaggtcctgagaccatgtgcccaaggtggtcagggcacagcttggctttatacattttagggaggcatgagacatcaatcagtatgtgtaagaagtacgttggtttggtctggaaaggcaggacaactagaaatgggaagggggcttccaggccataggtagataagagacaaacagttgaattattttgagtttctgaagatcagcctttcactgaatacacaatttacaggaatagtcacttatgccttagtctggcttagggaaacaacaggacaggggaagcaatctgatatgcatttatctcacatgagcagaggcatgactttgagctctgtcttttgtccacaggaaatttccttttgggcaaattgtgagggaggtatgtagcttttttatctttgtagctatcttatttaggaatagaatgcaaggcaggtttgcccaacacagttcccagctgactttttcgtttgtcttagtgatttgaggtcccaagatttttcttttcacaaatgactaaagcctggtgtaaaccctaagttggacccggagtgtcctgttctttgtagatttccaccgaatcgctgctgcctctggtgaagtagttcaagttcctccctagttcacctccctcagtgttcctcagccattcgacccattctaatttgcagtgtgccagtagcaaatgctttctcatttttcttgcagaatttagcctatgaaatcatcctaaccctgggacaggcattcgaagtcgcttaccagctagcactacaagcaagaaaagggggacactcctccacacttccagaaagctttgaaaacaaaccctccaaacccatccccaagccccgcgttagcattcgcaagtccgtggtaagtagaaacgatacagatgttctaaaaaaccttgaacaggaggaaaaggggctgctaaccaggcccttgtgtggtgtgggtgccattagaacccagggcctcttcttcatcctttcccttggcctcctcctggcatgtgtccatcatcacctctgcctggttcccaccaagtcttgggcaccatctccctcaacctggagcctccagagaaatccactttctcagtcacctgcagcaaccctatgaagggtctcagcagcaggtactgctgttcttggtgaatcttacctaaagattcaggaaagcttgggagcagtgttccctggggcttcagctgccatcccatcagagggcaaagcctcctacaagcccctggcctccagagaggtttgcagaggtacacagtgatgatgtcctcggtccccagctagaggaagctggatgcacaggctgccctgctatatgcaaggcctgcgccatggcctgcgtgctttgtctcccgcagctgaggcttcctgcggcatggtgcctgttcagaaggtgcagcccctccttctcagcatctgccttcctccaggaatttcttccccttccctcccacaggctctgcagacatcctgtcccaacaggcttgcatgacttcaaagcggcctcctctggtagtagcaatattcaaaagctggaagattcccaaccagcctcccatctggtttctgccccggctgccgtattgcatcctagaaaccctgggactcccccagaatgcattgctctcacgcccccgaatccttccatctggaactgtctctcctccttctcaccagcccccacctccactgtcatggggaacagcagcaggcatttttaacatttgcagggaggcacctccctttgtgaacatgcagttcttgttttcagtcttcttttgggggcctacccctgtcacccttcttggcaccatcaacatccacaggattgacccctccagcatctggtctcacagttccctgacagtttactttcgggatctttccctccagccccggccattcgctcctgtgtccatcactcattaccagccatccccaggagctgtatctcctctgaagtctttcttccgatgccacgctctgagcccctggtcctcccattcagcactgacccaacccaacacactggctcccagttctgtatctccagccctgggcaccccccaattccagactcacgtggccagcttctttcacatttccaccttgatgcttcacagacatctgaaacttagcatgtccaggacacaattcctgattttcccctcaaagctcttctctcaccaacttccccaccccacagccactcaccatgcaactcaagcccaaagtctacaagtcagcctggatccctgtcttccccttacctctgtatccagcccatgagcaaatcccatccaccctacccctaaaatatatctcaatcctgtccactcttccccacttcctccatctctcttccagtcggggccactgccacctcgccccaggcctatgcagtatagctccttgagactcccctccccacacagcagagatcagtcatggcaccctctgccccaagtacccagaatgcagtttcccaccacagtcctctgtgatgctcagctcttcccattccttgactatgtaatgctcactcctacctgaggcctttatgccacctgctccccacacctggaatatcctcccccggtttctgcatggctgacttcatcttgtcattcaggtctcggctacttgaagaggcggatgtcctaaccacccaatctgacatagatacccagtcaccttcaagcatgtcatctgcttttaattctgtgtagcatttattaattgagggttttttactgatggcttattgtctatcttcctccacaaaaatctaagttttgggccgggcacggtggctcacgcctgtaatcccagcactttgggagtccgaagcgggcagatcacgaggtcaggagatcgagattctcctggctaacacggtgaaaccccgtctctactaaaaatacaaaaaaaaaaaaaagttagctgggcgtggtggtgggtgcctgtagtcccagctactagggaggctgaggcaggagaatggcttgcacccgggaggcggagcttgcagcgagcagagattgagccactgcactccagcctgggcgacagagcaggactccgtctcaaaaaaaaaaatgtaagtttcatgcacacagggaccccacctgtgttgtcaccaccggaaccaggcccatagcaggtgttcagtgaatatctgtggatgacaaaatgagggcctgtggatggatttcacaagcatatctttgagattgattaggctgctaagtgtccaggaatttgcagaatgttttagagattatctcttagactattgtattcattctcatgtgggctgaataaatctgttcacagcaggtgcctctatctgaccttaccctggtccccacaggcttcttccagaagagcacaaagggttgggtggcataagagctcatagaatattcatccagatgccttcaagggaaataggaaaatatacagtgaataatactgatgttatttatgtgcttcaagatcagtccccctcgacaggcattagtattctagttccttcagccccaggcatttcttggtaagaaatattcagtgatccctaagaacacgtgaggtcctccccacagctttatggagatacagtcaaggcacggtagaaggcagctgcaaagctcatggtgccagagaaatgggagaggccttcccacaacctcaggctctgagaagagcaggcagctaggacagggcaggcagacctggaaacaccaaaggaagaggcagccatggtgtagatccacctgagggccgttcctgagagcggacagcccggccccgccccaggagtgtcccgttgtatttgtacgcacagggacgaaaccattttaggatttgtctcaaggcttagcctgactgggtccctgctcacctcctcacccttagctgtctgccttcccgctccccaccctgcaaactgaccccaacccctcaacgaccattttcccttacctctgggactgttttttattgctatgtgatattttgacacatgtatacaatatgtaatgatcatatcagtaattgagatatccatctcctcaaatatttttcttttgtattgagaaattacaattcttctagttattttgaaatatacaataaattgttgttaactacagtcaccctactgtgctatcaaatactagaacttactccttctatttaaccatatttttgtacctattaaccaatctctcttcatccctactctcccttcttcactttccagcctctggtaaccaccattctactcaatctccatgagatccactttttatagcctccacatatgagaacatacaatatttgtctttctgtgtctggcttatttcactcaacataatgaccttcagttcattcatgttgctgcaaatgacaggatctcattctttttatggctgaatagtattccgttgtgtatatataccacattttctttacccattcgtccattgatggacacttagtttgattccatgtcttggctgctgtgaataattctgcaataaacatgggagtgcagatatctctttgatatactgatttcttttcttttgtatatatacgcagtagtggggttgctggaacatatggtagctcaatttttagttttttgaggaccctccatgctattctccatagtgcctttcctaatttagattcctaccaacagtgtagaagtgtttccctttctctgtagcctcatcagcatccattagtttttgtctttttgatactagccattcaatagtagcgggggtgagatcgtatcacattgtgattgtcatttgcatgtccctgatgattagtgatgttgagcatttttacctatacctgttggccgtttgtatgtcgtctttttagaaatgcctgttcagttctattgcctgttacttaatcagattgagttggttttgtttttgtttttgttttttatttttgttttttgctattgagttatttgagtcccttatttattctggttgttaatcccttgtcagatggatactttgcaaatattttctcccattctgtaggttgtcttttcgctttgttgattgtttccttcgctgtgcagaagctttttcacttgatgtaattccatttgtctctttctgctttcgttgcctgtgcttttgagattttacccaaaaaatctttatccagaccaatgtcctgtagtgtttccccaatgttttcttccagttctttcatcgtctcaggtcttccctctaagtctttaatccattttgagttgatttctgtatatagtggaagatgaggctgtgtttcattctgttgtatagattattctgggactgctgcatgtgctgtttcatctacttcaaatgccccctcctcctgtcttcaggcaaatacttgctggtccttcggctgtccatttaaatattacctcattcttttgataccatttattcaacaagtatttattgtgtgcctattatttacggggttgccaggagcttttctgcgttttggagaaaatggcagtgatgaaaacagacaaaatcctgcctccatgagcatacgtggcagtggaggatgaacaaataaatatgtgatgacgcatagcggcaataagtattgtcaggaataaggcagaagaggagagcagaaaagttggggtgctttttgtaggagtaaacaggaaaggcttctaggaatacaggtgccagtggaagtggcatttgagcagagacctgaatggcattagagcatgaggcatgcaggtgtctggagaagggaactcgggcagagcagatgatgagcgcagaggccctgggcgtgggcttggcgggcaggaagagcaaggaagctgtgtggctgcagcagaaaaatcaggtgggcaggggtactggaggtcacggtgaggagttcgggttttgttctgactgactgtgatggaaaccactggagagtgagagccggggagtggcatgcctgattcacctcctccaggaagcccccctggctcccaaggtgtgtgtgcccacatggtgccctctcttcccctcgtatctcacctctcagcactgaaatccgcctctgtctgctccccgtctgtgtgctcacaagggcaagggctgtgccttattcaccgtcaccctcagggtgccctgcagagagtcggtatgcggtaaatgtgtgtccaaagagcgagcccgcgagccgcctagaccagcatcgccgccccgcgcctggggcgaggggcctcgcgtgggttcgccagcggcgtccgcgtgcatgcgcgcacccgcgcggcgaccgtataacaggcatcagcctttctgttttaaagcagatcgacccatctgagcaaaagactctggccaatctaccgtggattgtggagccgggccaagaagccaagaggggcattaataccaagtatgaaaccacgattttctgatactcgccgtcctcctgtcctcgcggtgccttgctcgccaagcggtcccggagcaggctttccttcgcgcctccgcgtccacccagcccaggaggaagactgctctgagcgtgcggccttgttacgggcgaaaggccactggccattcctggggaagttctttctgcaccagtgatggaaaacgcaagactttccagtcgcaacccctgagaggcgtgagttgagatgggttttccctgatgctcccgactcccctccccaccacctcccaaggtatttctgatgactccgccccagtacttgctttgcttcatttggggaaaataataccttttctttaaaaaaaaaaaaaaaaaaaaaaaagtaaaggggatctctaatactgcctaaaagtatgctttcactgtcagcagttttaaaggtgaaatcagagcagcactacccctcccacctccaaagcatctgtaaaatcattctatcattgagtatcgtttaatgcaaaaggacaaaaacaactcccgtgatatgattgccaggagattctgtttccccatttctatatttgtggattttatatgtaatcacctatgtcagagaaagaaaacctttcaaccaaatgattggttcaaaaggaaagaatgattcaaagcagaggaatttattatgcacagcaaaatgtgtcttgtattaaatatttttattaaaagaatgtttcattaatgcattgataagaaaactaggttagttgcgagggatgtttctggtttcatttcaaataattaaatttctactgctactaccaagaggactggctcagtggtggcaaaatactggtgatgctccctagagcaggaggcccggaagtgctgacgcagccatcagcctgccaagattgttttttaatcttcacagtgttttaaagaacatgttaaaaaaaaaaaaatctagtgctcctgctgtcaagatttctgtcatggaaaccttgtttgagaaaggtgttaataaaattctattgcaaaaatttctttttctagaaaaaataaatacaaaaaaaaaaaagaagaaattccaaagtaataaaacttttcttgagacaaacaaaaaaaaagtttgcttactatttgattaaataaaatttacttacatttctttaaggtattttaattttttaatgtctctgtggagtatttgtatgataccataatgtatatttatgtagaatcaaattatataaacagtaccaatatcattatagaaaaaaataacattttaatgtatattgttctaacaatcatattgtgaatcattttgaagttcattatagcgatattgataaattgtggaattgtcttaatgtttttttattaactgacattattttaaacctaactgagatgatcagttacattcatcagttggtgagttttgaagaataactacattttatttcaaactaacaaatgtatacggttttagttcagtgttgaagaattttaatacaatattaaattacttgaactg
